United States Patent 11,560,567 (GENETIC ELEMENTS DRIVING CIRCULAR RNA TRANSLATION AND METHODS OF USE) - sequence listing, part 3

SEQ ID NO: 31065 - DNA, 203 bp, Homo sapiens; identical to SEQ ID NO: 7336

SEQ ID NO: 31066 - DNA, 203 bp, Homo sapiens; identical to SEQ ID NO: 7361

SEQ ID NO: 31067 - DNA, 203 bp, Homo sapiens; identical to SEQ ID NO: 7362

SEQ ID NO: 31068 - DNA, 203 bp, Homo sapiens; identical to SEQ ID NO: 7369

SEQ ID NO: 31069 - DNA, 203 bp, Homo sapiens; identical to SEQ ID NO: 7371

SEQ ID NO: 31070 - DNA, 203 bp, Homo sapiens; identical to SEQ ID NO: 7395

SEQ ID NO: 31071 - DNA, 203 bp, Homo sapiens; identical to SEQ ID NO: 7432

SEQ ID NO: 31072 - DNA, 203 bp, Homo sapiens; identical to SEQ ID NO: 7475

SEQ ID NO: 31073 - DNA, 203 bp, Homo sapiens; identical to SEQ ID NO: 7510

SEQ ID NO: 31074 - DNA, 203 bp, Homo sapiens; identical to SEQ ID NO: 7511

SEQ ID NO: 31075 - DNA, 203 bp, Homo sapiens; identical to SEQ ID NO: 7512

SEQ ID NO: 31076 - DNA, 203 bp, Homo sapiens; identical to SEQ ID NO: 7515

SEQ ID NO: 31077 - DNA, 203 bp, Homo sapiens; identical to SEQ ID NO: 7529

SEQ ID NO: 31078 - DNA, 203 bp, Homo sapiens; identical to SEQ ID NO: 7552

SEQ ID NO: 31079 - DNA, 203 bp, Homo sapiens; identical to SEQ ID NO: 7555

SEQ ID NO: 31080 - DNA, 203 bp, Homo sapiens; identical to SEQ ID NO: 7556

SEQ ID NO: 31081 - DNA, 203 bp, Homo sapiens; identical to SEQ ID NO: 7567

SEQ ID NO: 31082 - DNA, 203 bp, Homo sapiens; identical to SEQ ID NO: 7576

SEQ ID NO: 31083 - DNA, 203 bp, Homo sapiens; identical to SEQ ID NO: 7578

SEQ ID NO: 31084 - DNA, 203 bp, Homo sapiens; identical to SEQ ID NO: 7579

SEQ ID NO: 31085 - DNA, 203 bp, Homo sapiens; identical to SEQ ID NO: 7580

SEQ ID NO: 31086 - DNA, 203 bp, Homo sapiens; identical to SEQ ID NO: 7581

SEQ ID NO: 31087 - DNA, 203 bp, Homo sapiens; identical to SEQ ID NO: 7582

SEQ ID NO: 31088 - DNA, 203 bp, Homo sapiens; identical to SEQ ID NO: 7583

SEQ ID NO: 31089 - DNA, 203 bp, Homo sapiens; identical to SEQ ID NO: 7584

SEQ ID NO: 31090 - DNA, 203 bp, Homo sapiens; identical to SEQ ID NO: 7585

SEQ ID NO: 31091 - DNA, 203 bp, Homo sapiens; identical to SEQ ID NO: 7586

SEQ ID NO: 31092 - DNA, 203 bp, Homo sapiens; identical to SEQ ID NO: 7587

SEQ ID NO: 31093 - DNA, 203 bp, Homo sapiens; identical to SEQ ID NO: 7588

SEQ ID NO: 31094 - DNA, 203 bp, Homo sapiens; identical to SEQ ID NO: 7589

SEQ ID NO: 31095 - DNA, 203 bp, Homo sapiens; identical to SEQ ID NO: 7590

SEQ ID NO: 31096 - DNA, 203 bp, Homo sapiens; identical to SEQ ID NO: 7591

SEQ ID NO: 31097 - DNA, 203 bp, Homo sapiens; identical to SEQ ID NO: 7592

SEQ ID NO: 31098 - DNA, 203 bp, Homo sapiens; identical to SEQ ID NO: 7593

SEQ ID NO: 31099 - DNA, 203 bp, Homo sapiens; identical to SEQ ID NO: 7594

SEQ ID NO: 31100 - DNA, 203 bp, Homo sapiens; identical to SEQ ID NO: 7595

SEQ ID NO: 31101 - DNA, 203 bp, Homo sapiens; identical to SEQ ID NO: 7596

SEQ ID NO: 31102 - DNA, 203 bp, Homo sapiens; identical to SEQ ID NO: 7597

SEQ ID NO: 31103 - DNA, 203 bp, Homo sapiens; identical to SEQ ID NO: 7598

SEQ ID NO: 31104 - DNA, 203 bp, Homo sapiens; identical to SEQ ID NO: 7599

SEQ ID NO: 31105 - DNA, 203 bp, Homo sapiens; identical to SEQ ID NO: 7600

SEQ ID NO: 31106 - DNA, 203 bp, Homo sapiens; identical to SEQ ID NO: 7601

SEQ ID NO: 31107 - DNA, 203 bp, Homo sapiens; identical to SEQ ID NO: 7602

SEQ ID NO: 31108 - DNA, 203 bp, Homo sapiens; identical to SEQ ID NO: 7603

SEQ ID NO: 31109 - DNA, 203 bp, Homo sapiens; identical to SEQ ID NO: 7605

SEQ ID NO: 31110 - DNA, 203 bp, Homo sapiens; identical to SEQ ID NO: 7606

SEQ ID NO: 31111 - DNA, 203 bp, Homo sapiens; identical to SEQ ID NO: 7607

SEQ ID NO: 31112 - DNA, 203 bp, Homo sapiens; identical to SEQ ID NO: 7608

SEQ ID NO: 31113 - DNA, 203 bp, Homo sapiens; identical to SEQ ID NO: 7609

SEQ ID NO: 31114 - DNA, 203 bp, Homo sapiens; identical to SEQ ID NO: 7610

SEQ ID NO: 31115 - DNA, 203 bp, Homo sapiens; identical to SEQ ID NO: 7611

SEQ ID NO: 31116 - DNA, 203 bp, Homo sapiens; identical to SEQ ID NO: 7612

SEQ ID NO: 31117 - DNA, 203 bp, Homo sapiens; identical to SEQ ID NO: 7613

SEQ ID NO: 31118 - DNA, 203 bp, Homo sapiens; identical to SEQ ID NO: 7614

SEQ ID NO: 31119 - DNA, 203 bp, Homo sapiens; identical to SEQ ID NO: 7615

SEQ ID NO: 31120 - DNA, 203 bp, Homo sapiens; identical to SEQ ID NO: 7616

SEQ ID NO: 31121 - DNA, 203 bp, Homo sapiens; identical to SEQ ID NO: 7617

SEQ ID NO: 31122 - DNA, 203 bp, Homo sapiens; identical to SEQ ID NO: 7618

SEQ ID NO: 31123 - DNA, 203 bp, Homo sapiens; identical to SEQ ID NO: 7619

SEQ ID NO: 31124 - DNA, 203 bp, Homo sapiens; identical to SEQ ID NO: 7620

SEQ ID NO: 31125 - DNA, 203 bp, Homo sapiens; identical to SEQ ID NO: 7621

SEQ ID NO: 31126 - DNA, 203 bp, Homo sapiens; identical to SEQ ID NO: 7622

SEQ ID NO: 31127 - DNA, 203 bp, Homo sapiens; identical to SEQ ID NO: 7623

SEQ ID NO: 31128 - DNA, 203 bp, Homo sapiens; identical to SEQ ID NO: 7625

SEQ ID NO: 31129 - DNA, 203 bp, Homo sapiens; identical to SEQ ID NO: 7626

SEQ ID NO: 31130 - DNA, 203 bp, Homo sapiens; identical to SEQ ID NO: 7627

SEQ ID NO: 31131 - DNA, 203 bp, Homo sapiens; identical to SEQ ID NO: 7628

SEQ ID NO: 31132 - DNA, 203 bp, Homo sapiens; identical to SEQ ID NO: 7629

SEQ ID NO: 31133 - DNA, 203 bp, Homo sapiens; identical to SEQ ID NO: 7630

SEQ ID NO: 31134 - DNA, 203 bp, Homo sapiens; identical to SEQ ID NO: 7631

SEQ ID NO: 31135 - DNA, 203 bp, Homo sapiens; identical to SEQ ID NO: 7632

SEQ ID NO: 31136 - DNA, 203 bp, Homo sapiens; identical to SEQ ID NO: 7633

SEQ ID NO: 31137 - DNA, 203 bp, Homo sapiens; identical to SEQ ID NO: 7634

SEQ ID NO: 31138 - DNA, 203 bp, Homo sapiens; identical to SEQ ID NO: 7635

SEQ ID NO: 31139 - DNA, 203 bp, Homo sapiens; identical to SEQ ID NO: 7636

SEQ ID NO: 31140 - DNA, 203 bp, Homo sapiens; identical to SEQ ID NO: 7637

SEQ ID NO: 31141 - DNA, 203 bp, Homo sapiens; identical to SEQ ID NO: 7638

SEQ ID NO: 31142 - DNA, 203 bp, Homo sapiens; identical to SEQ ID NO: 7639

SEQ ID NO: 31143 - DNA, 203 bp, Homo sapiens; identical to SEQ ID NO: 7640

SEQ ID NO: 31144 - DNA, 203 bp, Homo sapiens; identical to SEQ ID NO: 7641

SEQ ID NO: 31145 - DNA, 203 bp, Homo sapiens; identical to SEQ ID NO: 7642

SEQ ID NO: 31146 - DNA, 203 bp, Homo sapiens; identical to SEQ ID NO: 7643

SEQ ID NO: 31147 - DNA, 203 bp, Homo sapiens; identical to SEQ ID NO: 7644

SEQ ID NO: 31148 - DNA, 203 bp, Homo sapiens; identical to SEQ ID NO: 7648

SEQ ID NO: 31149 - DNA, 203 bp, Homo sapiens; identical to SEQ ID NO: 7649

SEQ ID NO: 31150 - DNA, 203 bp, Homo sapiens; identical to SEQ ID NO: 7650

SEQ ID NO: 31151 - DNA, 203 bp, Homo sapiens; identical to SEQ ID NO: 7651

SEQ ID NO: 31152 - DNA, 203 bp, Homo sapiens; identical to SEQ ID NO: 7652

SEQ ID NO: 31153 - DNA, 203 bp, Homo sapiens; identical to SEQ ID NO: 7653

SEQ ID NO: 31154 - DNA, 203 bp, Homo sapiens; identical to SEQ ID NO: 7654

SEQ ID NO: 31155 - DNA, 203 bp, Homo sapiens; identical to SEQ ID NO: 7655

SEQ ID NO: 31156 - DNA, 203 bp, Homo sapiens; identical to SEQ ID NO: 7656

SEQ ID NO: 31157 - DNA, 203 bp, Homo sapiens; identical to SEQ ID NO: 7657

SEQ ID NO: 31158 - DNA, 203 bp, Homo sapiens; identical to SEQ ID NO: 7658

SEQ ID NO: 31159 - DNA, 203 bp, Homo sapiens; identical to SEQ ID NO: 7659

SEQ ID NO: 31160 - DNA, 203 bp, Homo sapiens; identical to SEQ ID NO: 7660

SEQ ID NO: 31161 - DNA, 203 bp, Homo sapiens; identical to SEQ ID NO: 7661

SEQ ID NO: 31162 - DNA, 203 bp, Homo sapiens; identical to SEQ ID NO: 7662

SEQ ID NO: 31163 - DNA, 203 bp, Homo sapiens; identical to SEQ ID NO: 7663

SEQ ID NO: 31164 - DNA, 203 bp, Homo sapiens; identical to SEQ ID NO: 7664

SEQ ID NO: 31165 - DNA, 203 bp, Homo sapiens; identical to SEQ ID NO: 7665

SEQ ID NO: 31166 - DNA, 203 bp, Homo sapiens; identical to SEQ ID NO: 7666

SEQ ID NO: 31167 - DNA, 203 bp, Homo sapiens; identical to SEQ ID NO: 7667

SEQ ID NO: 31168 - DNA, 203 bp, Homo sapiens; identical to SEQ ID NO: 7668

SEQ ID NO: 31169 - DNA, 203 bp, Homo sapiens; identical to SEQ ID NO: 7669

SEQ ID NO: 31170 - DNA, 203 bp, Homo sapiens; identical to SEQ ID NO: 7670

SEQ ID NO: 31171 - DNA, 203 bp, Homo sapiens; identical to SEQ ID NO: 7671

SEQ ID NO: 31172 - DNA, 203 bp, Homo sapiens; identical to SEQ ID NO: 7673

SEQ ID NO: 31173 - DNA, 203 bp, Homo sapiens; identical to SEQ ID NO: 7674

SEQ ID NO: 31174 - DNA, 203 bp, Homo sapiens; identical to SEQ ID NO: 7675

SEQ ID NO: 31175 - DNA, 203 bp, Homo sapiens; identical to SEQ ID NO: 7676

SEQ ID NO: 31176 - DNA, 203 bp, Homo sapiens; identical to SEQ ID NO: 7677

SEQ ID NO: 31177 - DNA, 203 bp, Homo sapiens; identical to SEQ ID NO: 7678

SEQ ID NO: 31178 - DNA, 203 bp, Homo sapiens; identical to SEQ ID NO: 7679

SEQ ID NO: 31179 - DNA, 203 bp, Homo sapiens; identical to SEQ ID NO: 7680

SEQ ID NO: 31180 - DNA, 203 bp, Homo sapiens; identical to SEQ ID NO: 7681

SEQ ID NO: 31181 - DNA, 203 bp, Homo sapiens; identical to SEQ ID NO: 7682

SEQ ID NO: 31182 - DNA, 203 bp, Homo sapiens; identical to SEQ ID NO: 7694

SEQ ID NO: 31183 - DNA, 203 bp, Homo sapiens; identical to SEQ ID NO: 7695

SEQ ID NO: 31184 - DNA, 203 bp, Homo sapiens; identical to SEQ ID NO: 7696

SEQ ID NO: 31185 - DNA, 203 bp, Homo sapiens; identical to SEQ ID NO: 7697

SEQ ID NO: 31186 - DNA, 203 bp, Homo sapiens; identical to SEQ ID NO: 7698

SEQ ID NO: 31187 - DNA, 203 bp, Homo sapiens; identical to SEQ ID NO: 7699

SEQ ID NO: 31188 - DNA, 203 bp, Homo sapiens; identical to SEQ ID NO: 7700

SEQ ID NO: 31189 - DNA, 203 bp, Homo sapiens; identical to SEQ ID NO: 7701

SEQ ID NO: 31190 - DNA, 203 bp, Homo sapiens; identical to SEQ ID NO: 7702

SEQ ID NO: 31191 - DNA, 203 bp, Homo sapiens; identical to SEQ ID NO: 7703

SEQ ID NO: 31192 - DNA, 203 bp, Homo sapiens; identical to SEQ ID NO: 7704

SEQ ID NO: 31193 - DNA, 203 bp, Homo sapiens; identical to SEQ ID NO: 7705

SEQ ID NO: 31194 - DNA, 203 bp, Homo sapiens; identical to SEQ ID NO: 7706

SEQ ID NO: 31195 - DNA, 203 bp, Homo sapiens; identical to SEQ ID NO: 7707

SEQ ID NO: 31196 - DNA, 203 bp, Homo sapiens; identical to SEQ ID NO: 7708

SEQ ID NO: 31197 - DNA, 203 bp, Homo sapiens; identical to SEQ ID NO: 7709

SEQ ID NO: 31198 - DNA, 203 bp, Homo sapiens; identical to SEQ ID NO: 7710

SEQ ID NO: 31199 - DNA, 203 bp, Homo sapiens; identical to SEQ ID NO: 7711

SEQ ID NO: 31200 - DNA, 203 bp, Homo sapiens; identical to SEQ ID NO: 7712

SEQ ID NO: 31201 - DNA, 203 bp, Homo sapiens; identical to SEQ ID NO: 7713

SEQ ID NO: 31202 - DNA, 203 bp, Homo sapiens; identical to SEQ ID NO: 7714

SEQ ID NO: 31203 - DNA, 203 bp, Homo sapiens; identical to SEQ ID NO: 7715

SEQ ID NO: 31204 - DNA, 203 bp, Homo sapiens; identical to SEQ ID NO: 7716

SEQ ID NO: 31205 - DNA, 203 bp, Homo sapiens; identical to SEQ ID NO: 7717

SEQ ID NO: 31206 - DNA, 203 bp, Homo sapiens; identical to SEQ ID NO: 7718

SEQ ID NO: 31207 - DNA, 203 bp, Homo sapiens; identical to SEQ ID NO: 7720

SEQ ID NO: 31208 - DNA, 203 bp, Homo sapiens; identical to SEQ ID NO: 7724

SEQ ID NO: 31209 - DNA, 203 bp, Homo sapiens; identical to SEQ ID NO: 7725

SEQ ID NO: 31210 - DNA, 203 bp, Homo sapiens; identical to SEQ ID NO: 7726

SEQ ID NO: 31211 - DNA, 203 bp, Homo sapiens; identical to SEQ ID NO: 7727

SEQ ID NO: 31212 - DNA, 203 bp, Homo sapiens; identical to SEQ ID NO: 7728

SEQ ID NO: 31213 - DNA, 203 bp, Homo sapiens; identical to SEQ ID NO: 7729

SEQ ID NO: 31214 - DNA, 203 bp, Homo sapiens; identical to SEQ ID NO: 7730

SEQ ID NO: 31215 - DNA, 203 bp, Homo sapiens; identical to SEQ ID NO: 7731

SEQ ID NO: 31216 - DNA, 203 bp, Homo sapiens; identical to SEQ ID NO: 7732

SEQ ID NO: 31217 - DNA, 203 bp, Homo sapiens; identical to SEQ ID NO: 7733

SEQ ID NO: 31218 - DNA, 203 bp, Homo sapiens; identical to SEQ ID NO: 7734

SEQ ID NO: 31219 - DNA, 203 bp, Homo sapiens; identical to SEQ ID NO: 7735

SEQ ID NO: 31220 - DNA, 203 bp, Homo sapiens; identical to SEQ ID NO: 7736

SEQ ID NO: 31221 - DNA, 203 bp, Homo sapiens; identical to SEQ ID NO: 7748

SEQ ID NO: 31222 - DNA, 203 bp, Homo sapiens; identical to SEQ ID NO: 7771

SEQ ID NO: 31223 - DNA, 203 bp, Homo sapiens; identical to SEQ ID NO: 7805

SEQ ID NO: 31224 - DNA, 203 bp, Homo sapiens; identical to SEQ ID NO: 7806

SEQ ID NO: 31225 - DNA, 203 bp, Homo sapiens; identical to SEQ ID NO: 7807

SEQ ID NO: 31226 - DNA, 203 bp, Homo sapiens; identical to SEQ ID NO: 7808

SEQ ID NO: 31227 - DNA, 203 bp, Homo sapiens; identical to SEQ ID NO: 7809

SEQ ID NO: 31228 - DNA, 203 bp, Homo sapiens; identical to SEQ ID NO: 7810

SEQ ID NO: 31229 - DNA, 203 bp, Homo sapiens; identical to SEQ ID NO: 7811

SEQ ID NO: 31230 - DNA, 203 bp, Homo sapiens; identical to SEQ ID NO: 7812

SEQ ID NO: 31231 - DNA, 203 bp, Homo sapiens; identical to SEQ ID NO: 7813

SEQ ID NO: 31232 - DNA, 203 bp, Homo sapiens; identical to SEQ ID NO: 7814

SEQ ID NO: 31233 - DNA, 203 bp, Homo sapiens; identical to SEQ ID NO: 7815

SEQ ID NO: 31234 - DNA, 203 bp, Homo sapiens; identical to SEQ ID NO: 7816

SEQ ID NO: 31235 - DNA, 203 bp, Homo sapiens; identical to SEQ ID NO: 7817

SEQ ID NO: 31236 - DNA, 203 bp, Homo sapiens; identical to SEQ ID NO: 7818

SEQ ID NO: 31237 - DNA, 203 bp, Homo sapiens; identical to SEQ ID NO: 7843

SEQ ID NO: 31238 - DNA, 203 bp, Homo sapiens; identical to SEQ ID NO: 7845

SEQ ID NO: 31239 - DNA, 203 bp, Homo sapiens; identical to SEQ ID NO: 7846

SEQ ID NO: 31240 - DNA, 203 bp, Homo sapiens; identical to SEQ ID NO: 7847

SEQ ID NO: 31241 - DNA, 203 bp, Homo sapiens; identical to SEQ ID NO: 7848

SEQ ID NO: 31242 - DNA, 203 bp, Homo sapiens; identical to SEQ ID NO: 7849

SEQ ID NO: 31243 - DNA, 203 bp, Homo sapiens; identical to SEQ ID NO: 7850

SEQ ID NO: 31244 - DNA, 203 bp, Homo sapiens; identical to SEQ ID NO: 7851

SEQ ID NO: 31245 - DNA, 203 bp, Homo sapiens; identical to SEQ ID NO: 7852

SEQ ID NO: 31246 - DNA, 203 bp, Homo sapiens; identical to SEQ ID NO: 7853

SEQ ID NO: 31247 - DNA, 203 bp, Homo sapiens; identical to SEQ ID NO: 7854

SEQ ID NO: 31248 - DNA, 203 bp, Homo sapiens; identical to SEQ ID NO: 7855

SEQ ID NO: 31249 - DNA, 203 bp, Homo sapiens; identical to SEQ ID NO: 7856

SEQ ID NO: 31250 - DNA, 203 bp, Homo sapiens; identical to SEQ ID NO: 7857

SEQ ID NO: 31251 - DNA, 203 bp, Homo sapiens; identical to SEQ ID NO: 7858

SEQ ID NO: 31252 - DNA, 203 bp, Homo sapiens; identical to SEQ ID NO: 7859

SEQ ID NO: 31253 - DNA, 203 bp, Homo sapiens; identical to SEQ ID NO: 7865

SEQ ID NO: 31254 - DNA, 203 bp, Homo sapiens; identical to SEQ ID NO: 7899

SEQ ID NO: 31255 - DNA, 203 bp, Homo sapiens; identical to SEQ ID NO: 7903

SEQ ID NO: 31256 - DNA, 203 bp, Homo sapiens; identical to SEQ ID NO: 7907

SEQ ID NO: 31257 - DNA, 203 bp, Homo sapiens; identical to SEQ ID NO: 7910

SEQ ID NO: 31258 - DNA, 203 bp, Homo sapiens; identical to SEQ ID NO: 7912

SEQ ID NO: 31259 - DNA, 203 bp, Homo sapiens; identical to SEQ ID NO: 7913

SEQ ID NO: 31260 - DNA, 203 bp, Homo sapiens; identical to SEQ ID NO: 7917

SEQ ID NO: 31261 - DNA, 203 bp, Homo sapiens; identical to SEQ ID NO: 7919

SEQ ID NO: 31262 - DNA, 203 bp, Homo sapiens; identical to SEQ ID NO: 7920

SEQ ID NO: 31263 - DNA, 203 bp, Homo sapiens; identical to SEQ ID NO: 7921

SEQ ID NO: 31264 - DNA, 203 bp, Homo sapiens; identical to SEQ ID NO: 7926

SEQ ID NO: 31265 - DNA, 203 bp, Homo sapiens; identical to SEQ ID NO: 7927

SEQ ID NO: 31266 - DNA, 203 bp, Homo sapiens; identical to SEQ ID NO: 7928

SEQ ID NO: 31267 - DNA, 203 bp, Homo sapiens; identical to SEQ ID NO: 7929

SEQ ID NO: 31268 - DNA, 203 bp, Homo sapiens; identical to SEQ ID NO: 7930

SEQ ID NO: 31269 - DNA, 203 bp, Homo sapiens; identical to SEQ ID NO: 7931

SEQ ID NO: 31270 - DNA, 203 bp, Homo sapiens; identical to SEQ ID NO: 7932

SEQ ID NO: 31271 - DNA, 203 bp, Homo sapiens; identical to SEQ ID NO: 7933

SEQ ID NO: 31272 - DNA, 203 bp, Homo sapiens; identical to SEQ ID NO: 7934

SEQ ID NO: 31273 - DNA, 203 bp, Homo sapiens; identical to SEQ ID NO: 7935

SEQ ID NO: 31274 - DNA, 203 bp, Homo sapiens; identical to SEQ ID NO: 7936

SEQ ID NO: 31275 - DNA, 203 bp, Homo sapiens; identical to SEQ ID NO: 7937

SEQ ID NO: 31276 - DNA, 203 bp, Homo sapiens; identical to SEQ ID NO: 7938

SEQ ID NO: 31277 - DNA, 203 bp, Homo sapiens; identical to SEQ ID NO: 7939

SEQ ID NO: 31278 - DNA, 203 bp, Homo sapiens; identical to SEQ ID NO: 7940

SEQ ID NO: 31279 - DNA, 203 bp, Homo sapiens; identical to SEQ ID NO: 7941

SEQ ID NO: 31280 - DNA, 203 bp, Homo sapiens; identical to SEQ ID NO: 7942

SEQ ID NO: 31281 - DNA, 203 bp, Homo sapiens; identical to SEQ ID NO: 7943

SEQ ID NO: 31282 - DNA, 203 bp, Homo sapiens; identical to SEQ ID NO: 7944

SEQ ID NO: 31283 - DNA, 203 bp, Homo sapiens; identical to SEQ ID NO: 7948

SEQ ID NO: 31284 - DNA, 203 bp, Homo sapiens; identical to SEQ ID NO: 7952

SEQ ID NO: 31285 - DNA, 203 bp, Homo sapiens; identical to SEQ ID NO: 7958

SEQ ID NO: 31286 - DNA, 203 bp, Homo sapiens; identical to SEQ ID NO: 7964

SEQ ID NO: 31287 - DNA, 203 bp, Homo sapiens; identical to SEQ ID NO: 7986

SEQ ID NO: 31288 - DNA, 203 bp, Homo sapiens; identical to SEQ ID NO: 8014

SEQ ID NO: 31289 - DNA, 203 bp, Homo sapiens; identical to SEQ ID NO: 8019

SEQ ID NO: 31290 - DNA, 203 bp, Homo sapiens; identical to SEQ ID NO: 8062

SEQ ID NO: 31291 - DNA, 203 bp, Homo sapiens; identical to SEQ ID NO: 8063

SEQ ID NO: 31292 - DNA, 203 bp, Homo sapiens; identical to SEQ ID NO: 8064

SEQ ID NO: 31293 - DNA, 203 bp, Homo sapiens; identical to SEQ ID NO: 8065

SEQ ID NO: 31294 - DNA, 203 bp, Homo sapiens; identical to SEQ ID NO: 8066

SEQ ID NO: 31295 - DNA, 203 bp, Homo sapiens; identical to SEQ ID NO: 8067

SEQ ID NO: 31296 - DNA, 203 bp, Homo sapiens; identical to SEQ ID NO: 8068

SEQ ID NO: 31297 - DNA, 203 bp, Homo sapiens; identical to SEQ ID NO: 8069

SEQ ID NO: 31298 - DNA, 203 bp, Homo sapiens; identical to SEQ ID NO: 8070

SEQ ID NO: 31299 - DNA, 203 bp, Homo sapiens; identical to SEQ ID NO: 8071

SEQ ID NO: 31300 - DNA, 203 bp, Homo sapiens; identical to SEQ ID NO: 8072

SEQ ID NO: 31301 - DNA, 203 bp, Homo sapiens; identical to SEQ ID NO: 8073

SEQ ID NO: 31302 - DNA, 203 bp, Homo sapiens; identical to SEQ ID NO: 8076

SEQ ID NO: 31303 - DNA, 203 bp, Homo sapiens; identical to SEQ ID NO: 8077

SEQ ID NO: 31304 - DNA, 203 bp, Homo sapiens; identical to SEQ ID NO: 8078

SEQ ID NO: 31305 - DNA, 203 bp, Homo sapiens; identical to SEQ ID NO: 8079

SEQ ID NO: 31306 - DNA, 203 bp, Homo sapiens; identical to SEQ ID NO: 8080

SEQ ID NO: 31307 - DNA, 203 bp, Homo sapiens; identical to SEQ ID NO: 8081

SEQ ID NO: 31308 - DNA, 203 bp, Homo sapiens; identical to SEQ ID NO: 8082

SEQ ID NO: 31309 - DNA, 203 bp, Homo sapiens; identical to SEQ ID NO: 8083

SEQ ID NO: 31310 - DNA, 203 bp, Homo sapiens; identical to SEQ ID NO: 8084

SEQ ID NO: 31311 - DNA, 203 bp, Homo sapiens; identical to SEQ ID NO: 8085

SEQ ID NO: 31312 - DNA, 203 bp, Homo sapiens; identical to SEQ ID NO: 8086

SEQ ID NO: 31313 - DNA, 203 bp, Homo sapiens; identical to SEQ ID NO: 8087

SEQ ID NO: 31314 - DNA, 203 bp, Homo sapiens; identical to SEQ ID NO: 8088

SEQ ID NO: 31315 - DNA, 203 bp, Homo sapiens; identical to SEQ ID NO: 8089

SEQ ID NO: 31316 - DNA, 203 bp, Homo sapiens; identical to SEQ ID NO: 8104

SEQ ID NO: 31317 - DNA, 203 bp, Homo sapiens; identical to SEQ ID NO: 8105

SEQ ID NO: 31318 - DNA, 203 bp, Homo sapiens; identical to SEQ ID NO: 8106

SEQ ID NO: 31319 - DNA, 203 bp, Homo sapiens; identical to SEQ ID NO: 8107

SEQ ID NO: 31320 - DNA, 203 bp, Homo sapiens; identical to SEQ ID NO: 8108

SEQ ID NO: 31321 - DNA, 203 bp, Homo sapiens; identical to SEQ ID NO: 8109

SEQ ID NO: 31322 - DNA, 203 bp, Homo sapiens; identical to SEQ ID NO: 8110

SEQ ID NO: 31323 - DNA, 203 bp, Homo sapiens; identical to SEQ ID NO: 8111

SEQ ID NO: 31324 - DNA, 203 bp, Homo sapiens; identical to SEQ ID NO: 8112

SEQ ID NO: 31325 - DNA, 203 bp, Homo sapiens; identical to SEQ ID NO: 8113

SEQ ID NO: 31326 - DNA, 203 bp, Homo sapiens; identical to SEQ ID NO: 8138

SEQ ID NO: 31327 - DNA, 203 bp, Homo sapiens; identical to SEQ ID NO: 8139

SEQ ID NO: 31328 - DNA, 203 bp, Homo sapiens; identical to SEQ ID NO: 8140

SEQ ID NO: 31329 - DNA, 203 bp, Homo sapiens; identical to SEQ ID NO: 8141

SEQ ID NO: 31330 - DNA, 203 bp, Homo sapiens; identical to SEQ ID NO: 8142

SEQ ID NO: 31331 - DNA, 203 bp, Homo sapiens; identical to SEQ ID NO: 8143

SEQ ID NO: 31332 - DNA, 203 bp, Homo sapiens; identical to SEQ ID NO: 8144

SEQ ID NO: 31333 - DNA, 203 bp, Homo sapiens; identical to SEQ ID NO: 8145

SEQ ID NO: 31334 - DNA, 203 bp, Homo sapiens; identical to SEQ ID NO: 8146

SEQ ID NO: 31335 - DNA, 203 bp, Homo sapiens; identical to SEQ ID NO: 8147

SEQ ID NO: 31336 - DNA, 203 bp, Homo sapiens; identical to SEQ ID NO: 8148

SEQ ID NO: 31337 - DNA, 203 bp, Homo sapiens; identical to SEQ ID NO: 8149

SEQ ID NO: 31338 - DNA, 203 bp, Homo sapiens; identical to SEQ ID NO: 8150

SEQ ID NO: 31339 - DNA, 203 bp, Homo sapiens; identical to SEQ ID NO: 8151

SEQ ID NO: 31340 - DNA, 203 bp, Homo sapiens; identical to SEQ ID NO: 8152

SEQ ID NO: 31341 - DNA, 203 bp, Homo sapiens; identical to SEQ ID NO: 8153

SEQ ID NO: 31342 - DNA, 203 bp, Homo sapiens; identical to SEQ ID NO: 8154

SEQ ID NO: 31343 - DNA, 203 bp, Homo sapiens; identical to SEQ ID NO: 8155

SEQ ID NO: 31344 - DNA, 203 bp, Homo sapiens; identical to SEQ ID NO: 8156

SEQ ID NO: 31345 - DNA, 203 bp, Homo sapiens; identical to SEQ ID NO: 8157

SEQ ID NO: 31346 - DNA, 203 bp, Homo sapiens; identical to SEQ ID NO: 8158

SEQ ID NO: 31347 - DNA, 203 bp, Homo sapiens; identical to SEQ ID NO: 8159

SEQ ID NO: 31348 - DNA, 203 bp, Homo sapiens; identical to SEQ ID NO: 8160

SEQ ID NO: 31349 - DNA, 203 bp, Homo sapiens; identical to SEQ ID NO: 8169

SEQ ID NO: 31350 - DNA, 203 bp, Homo sapiens; identical to SEQ ID NO: 8171

SEQ ID NO: 31351 - DNA, 203 bp, Homo sapiens; identical to SEQ ID NO: 8173

SEQ ID NO: 31352 - DNA, 203 bp, Homo sapiens; identical to SEQ ID NO: 8193

SEQ ID NO: 31353 - DNA, 203 bp, Homo sapiens; identical to SEQ ID NO: 8196

SEQ ID NO: 31354 - DNA, 203 bp, Homo sapiens; identical to SEQ ID NO: 8199

SEQ ID NO: 31355 - DNA, 203 bp, Homo sapiens; identical to SEQ ID NO: 8225

SEQ ID NO: 31356 - DNA, 203 bp, Homo sapiens; identical to SEQ ID NO: 8239

SEQ ID NO: 31357 - DNA, 203 bp, Homo sapiens; identical to SEQ ID NO: 8266

SEQ ID NO: 31358 - DNA, 203 bp, Homo sapiens; identical to SEQ ID NO: 8269

SEQ ID NO: 31359 - DNA, 203 bp, Homo sapiens; identical to SEQ ID NO: 8270

SEQ ID NO: 31360 - DNA, 203 bp, Homo sapiens; identical to SEQ ID NO: 8271

SEQ ID NO: 31361 - DNA, 203 bp, Homo sapiens; identical to SEQ ID NO: 8272

SEQ ID NO: 31362 - DNA, 203 bp, Homo sapiens; identical to SEQ ID NO: 8273

SEQ ID NO: 31363 - DNA, 203 bp, Homo sapiens; identical to SEQ ID NO: 8274

SEQ ID NO: 31364 - DNA, 203 bp, Homo sapiens; identical to SEQ ID NO: 8275

SEQ ID NO: 31365 - DNA, 203 bp, Homo sapiens; identical to SEQ ID NO: 8276

SEQ ID NO: 31366 - DNA, 203 bp, Homo sapiens; identical to SEQ ID NO: 8277

SEQ ID NO: 31367 - DNA, 203 bp, Homo sapiens; identical to SEQ ID NO: 8278

SEQ ID NO: 31368 - DNA, 203 bp, Homo sapiens; identical to SEQ ID NO: 8279

SEQ ID NO: 31369 - DNA, 203 bp, Homo sapiens; identical to SEQ ID NO: 8280

SEQ ID NO: 31370 - DNA, 203 bp, Homo sapiens; identical to SEQ ID NO: 8281

SEQ ID NO: 31371 - DNA, 203 bp, Homo sapiens; identical to SEQ ID NO: 8282

SEQ ID NO: 31372 - DNA, 203 bp, Homo sapiens; identical to SEQ ID NO: 8283

SEQ ID NO: 31373 - DNA, 203 bp, Homo sapiens; identical to SEQ ID NO: 8284

SEQ ID NO: 31374 - DNA, 203 bp, Homo sapiens; identical to SEQ ID NO: 8295

SEQ ID NO: 31375 - DNA, 203 bp, Homo sapiens; identical to SEQ ID NO: 8315

SEQ ID NO: 31376 - DNA, 203 bp, Homo sapiens; identical to SEQ ID NO: 8329

SEQ ID NO: 31377 - DNA, 203 bp, Homo sapiens; identical to SEQ ID NO: 8331

SEQ ID NO: 31378 - DNA, 203 bp, Homo sapiens; identical to SEQ ID NO: 8332

SEQ ID NO: 31379 - DNA, 203 bp, Homo sapiens; identical to SEQ ID NO: 8333

SEQ ID NO: 31380 - DNA, 203 bp, Homo sapiens; identical to SEQ ID NO: 8334

SEQ ID NO: 31381 - DNA, 203 bp, Homo sapiens; identical to SEQ ID NO: 8335

SEQ ID NO: 31382 - DNA, 203 bp, Homo sapiens; identical to SEQ ID NO: 8336

SEQ ID NO: 31383 - DNA, 203 bp, Homo sapiens; identical to SEQ ID NO: 8337

SEQ ID NO: 31384 - DNA, 203 bp, Homo sapiens; identical to SEQ ID NO: 8338

SEQ ID NO: 31385 - DNA, 203 bp, Homo sapiens; identical to SEQ ID NO: 8339

SEQ ID NO: 31386 - DNA, 203 bp, Homo sapiens; identical to SEQ ID NO: 8340

SEQ ID NO: 31387 - DNA, 203 bp, Homo sapiens; identical to SEQ ID NO: 8341

SEQ ID NO: 31388 - DNA, 203 bp, Homo sapiens; identical to SEQ ID NO: 8342

SEQ ID NO: 31389 - DNA, 203 bp, Homo sapiens; identical to SEQ ID NO: 8368

SEQ ID NO: 31390 - DNA, 203 bp, Homo sapiens; identical to SEQ ID NO: 8369

SEQ ID NO: 31391 - DNA, 203 bp, Homo sapiens; identical to SEQ ID NO: 8370

SEQ ID NO: 31392 - DNA, 203 bp, Homo sapiens; identical to SEQ ID NO: 8371

SEQ ID NO: 31393 - DNA, 203 bp, Homo sapiens; identical to SEQ ID NO: 8372

SEQ ID NO: 31394 - DNA, 203 bp, Homo sapiens; identical to SEQ ID NO: 8373

SEQ ID NO: 31395 - DNA, 203 bp, Homo sapiens; identical to SEQ ID NO: 8374

SEQ ID NO: 31396 - DNA, 203 bp, Homo sapiens; identical to SEQ ID NO: 8375

SEQ ID NO: 31397 - DNA, 203 bp, Homo sapiens; identical to SEQ ID NO: 8379

SEQ ID NO: 31398 - DNA, 203 bp, Homo sapiens; identical to SEQ ID NO: 8380

SEQ ID NO: 31399 - DNA, 203 bp, Homo sapiens; identical to SEQ ID NO: 8381

SEQ ID NO: 31400 - DNA, 203 bp, Homo sapiens; identical to SEQ ID NO: 8382

SEQ ID NO: 31401 - DNA, 203 bp, Homo sapiens; identical to SEQ ID NO: 8383

SEQ ID NO: 31402 - DNA, 203 bp, Homo sapiens; identical to SEQ ID NO: 8384

SEQ ID NO: 31403 - DNA, 203 bp, Homo sapiens; identical to SEQ ID NO: 8385

SEQ ID NO: 31404 - DNA, 203 bp, Homo sapiens; identical to SEQ ID NO: 8386

SEQ ID NO: 31405 - DNA, 203 bp, Homo sapiens; identical to SEQ ID NO: 8387

SEQ ID NO: 31406 - DNA, 203 bp, Homo sapiens; identical to SEQ ID NO: 8388

SEQ ID NO: 31407 - DNA, 203 bp, Homo sapiens; identical to SEQ ID NO: 8407

SEQ ID NO: 31408 - DNA, 203 bp, Homo sapiens; identical to SEQ ID NO: 8422

SEQ ID NO: 31409 - DNA, 203 bp, Homo sapiens; identical to SEQ ID NO: 8442

SEQ ID NO: 31410 - DNA, 203 bp, Homo sapiens; identical to SEQ ID NO: 8451

SEQ ID NO: 31411 - DNA, 203 bp, Homo sapiens; identical to SEQ ID NO: 8469

SEQ ID NO: 31412 - DNA, 203 bp, Homo sapiens; identical to SEQ ID NO: 8490

SEQ ID NO: 31413 - DNA, 203 bp, Homo sapiens; identical to SEQ ID NO: 8493

SEQ ID NO: 31414 - DNA, 203 bp, Homo sapiens; identical to SEQ ID NO: 8506

SEQ ID NO: 31415 - DNA, 203 bp, Homo sapiens; identical to SEQ ID NO: 8538

SEQ ID NO: 31416 - DNA, 203 bp, Homo sapiens; identical to SEQ ID NO: 8539

SEQ ID NO: 31417 - DNA, 203 bp, Homo sapiens; identical to SEQ ID NO: 8540

SEQ ID NO: 31418 - DNA, 203 bp, Homo sapiens; identical to SEQ ID NO: 8541

SEQ ID NO: 31419 - DNA, 203 bp, Homo sapiens; identical to SEQ ID NO: 8542

SEQ ID NO: 31420 - DNA, 203 bp, Homo sapiens; identical to SEQ ID NO: 8543

SEQ ID NO: 31421 - DNA, 203 bp, Homo sapiens; identical to SEQ ID NO: 8544

SEQ ID NO: 31422 - DNA, 203 bp, Homo sapiens; identical to SEQ ID NO: 8545

SEQ ID NO: 31423 - DNA, 203 bp, Homo sapiens; identical to SEQ ID NO: 8546

SEQ ID NO: 31424 - DNA, 203 bp, Homo sapiens; identical to SEQ ID NO: 8547

SEQ ID NO: 31425 - DNA, 203 bp, Homo sapiens; identical to SEQ ID NO: 8548

SEQ ID NO: 31426 - DNA, 203 bp, Homo sapiens; identical to SEQ ID NO: 8549

SEQ ID NO: 31427 - DNA, 203 bp, Homo sapiens; identical to SEQ ID NO: 8577

SEQ ID NO: 31428 - DNA, 203 bp, Homo sapiens; identical to SEQ ID NO: 8578

SEQ ID NO: 31429 - DNA, 203 bp, Homo sapiens; identical to SEQ ID NO: 8579

SEQ ID NO: 31430 - DNA, 203 bp, Homo sapiens; identical to SEQ ID NO: 8580

SEQ ID NO: 31431 - DNA, 203 bp, Homo sapiens; identical to SEQ ID NO: 8581

SEQ ID NO: 31432 - DNA, 203 bp, Homo sapiens; identical to SEQ ID NO: 8582

SEQ ID NO: 31433 - DNA, 203 bp, Homo sapiens; identical to SEQ ID NO: 8583

SEQ ID NO: 31434 - DNA, 203 bp, Homo sapiens; identical to SEQ ID NO: 8584

SEQ ID NO: 31435 - DNA, 203 bp, Homo sapiens; identical to SEQ ID NO: 8585

SEQ ID NO: 31436 - DNA, 203 bp, Homo sapiens; identical to SEQ ID NO: 8586

SEQ ID NO: 31437 - DNA, 203 bp, Homo sapiens; identical to SEQ ID NO: 8587

SEQ ID NO: 31438 - DNA, 203 bp, Homo sapiens; identical to SEQ ID NO: 8588

SEQ ID NO: 31439 - DNA, 203 bp, Homo sapiens; identical to SEQ ID NO: 8589

SEQ ID NO: 31440 - DNA, 203 bp, Homo sapiens; identical to SEQ ID NO: 8590

SEQ ID NO: 31441 - DNA, 203 bp, Homo sapiens; identical to SEQ ID NO: 8591

SEQ ID NO: 31442 - DNA, 203 bp, Homo sapiens; identical to SEQ ID NO: 8592

SEQ ID NO: 31443 - DNA, 203 bp, Homo sapiens; identical to SEQ ID NO: 8593

SEQ ID NO: 31444 - DNA, 203 bp, Homo sapiens; identical to SEQ ID NO: 8594

SEQ ID NO: 31445 - DNA, 203 bp, Homo sapiens; identical to SEQ ID NO: 8595

SEQ ID NO: 31446 - DNA, 203 bp, Homo sapiens; identical to SEQ ID NO: 8596

SEQ ID NO: 31447 - DNA, 203 bp, Homo sapiens; identical to SEQ ID NO: 8597

SEQ ID NO: 31448 - DNA, 203 bp, Homo sapiens; identical to SEQ ID NO: 8598

SEQ ID NO: 31449 - DNA, 203 bp, Homo sapiens; identical to SEQ ID NO: 8599

SEQ ID NO: 31450 - DNA, 203 bp, Homo sapiens; identical to SEQ ID NO: 8600

SEQ ID NO: 31451 - DNA, 203 bp, Homo sapiens; identical to SEQ ID NO: 8601

SEQ ID NO: 31452 - DNA, 203 bp, Homo sapiens; identical to SEQ ID NO: 8602

SEQ ID NO: 31453 - DNA, 203 bp, Homo sapiens; identical to SEQ ID NO: 8605

SEQ ID NO: 31454 - DNA, 203 bp, Homo sapiens; identical to SEQ ID NO: 8606

SEQ ID NO: 31455 - DNA, 203 bp, Homo sapiens; identical to SEQ ID NO: 8607

SEQ ID NO: 31456 - DNA, 203 bp, Homo sapiens; identical to SEQ ID NO: 8608

SEQ ID NO: 31457 - DNA, 203 bp, Homo sapiens; identical to SEQ ID NO: 8609

SEQ ID NO: 31458 - DNA, 203 bp, Homo sapiens; identical to SEQ ID NO: 8610

SEQ ID NO: 31459 - DNA, 203 bp, Homo sapiens; identical to SEQ ID NO: 8611

SEQ ID NO: 31460 - DNA, 203 bp, Homo sapiens; identical to SEQ ID NO: 8612

SEQ ID NO: 31461 - DNA, 203 bp, Homo sapiens; identical to SEQ ID NO: 8613

SEQ ID NO: 31462 - DNA, 203 bp, Homo sapiens; identical to SEQ ID NO: 8614

SEQ ID NO: 31463 - DNA, 203 bp, Homo sapiens; identical to SEQ ID NO: 8615

SEQ ID NO: 31464 - DNA, 203 bp, Homo sapiens; identical to SEQ ID NO: 8616

SEQ ID NO: 31465 - DNA, 203 bp, Homo sapiens; identical to SEQ ID NO: 8617

SEQ ID NO: 31466 - DNA, 203 bp, Homo sapiens; identical to SEQ ID NO: 8618

SEQ ID NO: 31467 - DNA, 203 bp, Homo sapiens; identical to SEQ ID NO: 8619

SEQ ID NO: 31468 - DNA, 203 bp, Homo sapiens; identical to SEQ ID NO: 8620

SEQ ID NO: 31469 - DNA, 203 bp, Homo sapiens; identical to SEQ ID NO: 8621

SEQ ID NO: 31470 - DNA, 203 bp, Homo sapiens; identical to SEQ ID NO: 8632

SEQ ID NO: 31471 - DNA, 203 bp, Homo sapiens; identical to SEQ ID NO: 8651

SEQ ID NO: 31472 - DNA, 203 bp, Homo sapiens; identical to SEQ ID NO: 8652

SEQ ID NO: 31473 - DNA, 203 bp, Homo sapiens; identical to SEQ ID NO: 8653

SEQ ID NO: 31474 - DNA, 203 bp, Homo sapiens; identical to SEQ ID NO: 8654

SEQ ID NO: 31475 - DNA, 203 bp, Homo sapiens; identical to SEQ ID NO: 8655

SEQ ID NO: 31476 - DNA, 203 bp, Homo sapiens; identical to SEQ ID NO: 8656

SEQ ID NO: 31477 - DNA, 203 bp, Homo sapiens; identical to SEQ ID NO: 8660

SEQ ID NO: 31478 - DNA, 203 bp, Homo sapiens; identical to SEQ ID NO: 8661

SEQ ID NO: 31479 - DNA, 203 bp, Homo sapiens; identical to SEQ ID NO: 8662

SEQ ID NO: 31480 - DNA, 203 bp, Homo sapiens; identical to SEQ ID NO: 8663

SEQ ID NO: 31481 - DNA, 203 bp, Homo sapiens; identical to SEQ ID NO: 8664

SEQ ID NO: 31482 - DNA, 203 bp, Homo sapiens; identical to SEQ ID NO: 8665

SEQ ID NO: 31483 - DNA, 203 bp, Homo sapiens; identical to SEQ ID NO: 8666

SEQ ID NO: 31484 - DNA, 203 bp, Homo sapiens; identical to SEQ ID NO: 8667

SEQ ID NO: 31485 - DNA, 203 bp, Homo sapiens; identical to SEQ ID NO: 8668

SEQ ID NO: 31486 - DNA, 203 bp, Homo sapiens; identical to SEQ ID NO: 8669

SEQ ID NO: 31487 - DNA, 203 bp, Homo sapiens; identical to SEQ ID NO: 8670

SEQ ID NO: 31488 - DNA, 203 bp, Homo sapiens; identical to SEQ ID NO: 8679

SEQ ID NO: 31489 - DNA, 203 bp, Homo sapiens; identical to SEQ ID NO: 8697

SEQ ID NO: 31490 - DNA, 203 bp, Homo sapiens; identical to SEQ ID NO: 8722

SEQ ID NO: 31491 - DNA, 203 bp, Homo sapiens; identical to SEQ ID NO: 8723

SEQ ID NO: 31492 - DNA, 203 bp, Homo sapiens; identical to SEQ ID NO: 8724

SEQ ID NO: 31493 - DNA, 203 bp, Homo sapiens; identical to SEQ ID NO: 8725

SEQ ID NO: 31494 - DNA, 203 bp, Homo sapiens; identical to SEQ ID NO: 8726

SEQ ID NO: 31495 - DNA, 203 bp, Homo sapiens; identical to SEQ ID NO: 8727

SEQ ID NO: 31496 - DNA, 203 bp, Homo sapiens; identical to SEQ ID NO: 8728

SEQ ID NO: 31497 - DNA, 203 bp, Homo sapiens; identical to SEQ ID NO: 8729

SEQ ID NO: 31498 - DNA, 203 bp, Homo sapiens; identical to SEQ ID NO: 8730

SEQ ID NO: 31499 - DNA, 203 bp, Homo sapiens; identical to SEQ ID NO: 8731

SEQ ID NO: 31500 - DNA, 203 bp, Homo sapiens; identical to SEQ ID NO: 8732

SEQ ID NO: 31501 - DNA, 203 bp, Homo sapiens; identical to SEQ ID NO: 8733

SEQ ID NO: 31502 - DNA, 203 bp, Homo sapiens; identical to SEQ ID NO: 8734

SEQ ID NO: 31503 - DNA, 203 bp, Homo sapiens; identical to SEQ ID NO: 8735

SEQ ID NO: 31504 - DNA, 203 bp, Homo sapiens; identical to SEQ ID NO: 8736

SEQ ID NO: 31505 - DNA, 203 bp, Homo sapiens; identical to SEQ ID NO: 8737

SEQ ID NO: 31506 - DNA, 203 bp, Homo sapiens; identical to SEQ ID NO: 8738

SEQ ID NO: 31507 - DNA, 203 bp, Homo sapiens; identical to SEQ ID NO: 8739

SEQ ID NO: 31508 - DNA, 203 bp, Homo sapiens; identical to SEQ ID NO: 8740

SEQ ID NO: 31509 - DNA, 203 bp, Homo sapiens; identical to SEQ ID NO: 8741

SEQ ID NO: 31510 - DNA, 203 bp, Homo sapiens; identical to SEQ ID NO: 8742

SEQ ID NO: 31511 - DNA, 203 bp, Homo sapiens; identical to SEQ ID NO: 8743

SEQ ID NO: 31512 - DNA, 203 bp, Homo sapiens; identical to SEQ ID NO: 8744

SEQ ID NO: 31513 - DNA, 203 bp, Homo sapiens; identical to SEQ ID NO: 8745

SEQ ID NO: 31514 - DNA, 203 bp, Homo sapiens; identical to SEQ ID NO: 8746

SEQ ID NO: 31515 - DNA, 203 bp, Homo sapiens; identical to SEQ ID NO: 8756

SEQ ID NO: 31516 - DNA, 203 bp, Homo sapiens; identical to SEQ ID NO: 8757

SEQ ID NO: 31517 - DNA, 203 bp, Homo sapiens; identical to SEQ ID NO: 8764

SEQ ID NO: 31518 - DNA, 203 bp, Homo sapiens; identical to SEQ ID NO: 8766

SEQ ID NO: 31519 - DNA, 203 bp, Homo sapiens; identical to SEQ ID NO: 8775

SEQ ID NO: 31520 - DNA, 203 bp, Homo sapiens; identical to SEQ ID NO: 8777

SEQ ID NO: 31521 - DNA, 203 bp, Homo sapiens; identical to SEQ ID NO: 8786

SEQ ID NO: 31522 - DNA, 203 bp, Homo sapiens; identical to SEQ ID NO: 8788

SEQ ID NO: 31523 - DNA, 203 bp, Homo sapiens; identical to SEQ ID NO: 12

SEQ ID NO: 31524 - DNA, 203 bp, Homo sapiens; identical to SEQ ID NO: 13

SEQ ID NO: 31525 - DNA, 203 bp, Homo sapiens; identical to SEQ ID NO: 23

SEQ ID NO: 31526 - DNA, 203 bp, Homo sapiens; identical to SEQ ID NO: 29

SEQ ID NO: 31527 - DNA, 203 bp, Homo sapiens; identical to SEQ ID NO: 32

SEQ ID NO: 31528 - DNA, 203 bp, Homo sapiens; identical to SEQ ID NO: 35

SEQ ID NO: 31529 - DNA, 203 bp, Homo sapiens; identical to SEQ ID NO: 40

SEQ ID NO: 31530 - DNA, 203 bp, Homo sapiens; identical to SEQ ID NO: 44

SEQ ID NO: 31531 - DNA, 203 bp, Homo sapiens; identical to SEQ ID NO: 45

SEQ ID NO: 31532 - DNA, 203 bp, Homo sapiens; identical to SEQ ID NO: 54

SEQ ID NO: 31533 - DNA, 203 bp, Homo sapiens; identical to SEQ ID NO: 61

SEQ ID NO: 31534 - DNA, 203 bp, Homo sapiens; identical to SEQ ID NO: 62

SEQ ID NO: 31535 - DNA, 203 bp, Homo sapiens; identical to SEQ ID NO: 63

SEQ ID NO: 31536 - DNA, 203 bp, Homo sapiens; identical to SEQ ID NO: 65

SEQ ID NO: 31537 - DNA, 203 bp, Homo sapiens; identical to SEQ ID NO: 66

SEQ ID NO: 31538 - DNA, 203 bp, Homo sapiens; identical to SEQ ID NO: 67

SEQ ID NO: 31539 - DNA, 203 bp, Homo sapiens; identical to SEQ ID NO: 70

SEQ ID NO: 31540 - DNA, 203 bp, Homo sapiens; identical to SEQ ID NO: 72

SEQ ID NO: 31541 - DNA, 203 bp, Homo sapiens; identical to SEQ ID NO: 75

SEQ ID NO: 31542 - DNA, 203 bp, Homo sapiens; identical to SEQ ID NO: 77

SEQ ID NO: 31543 - DNA, 203 bp, Homo sapiens; identical to SEQ ID NO: 83

SEQ ID NO: 31544 - DNA, 203 bp, Homo sapiens; identical to SEQ ID NO: 84

SEQ ID NO: 31545 - DNA, 203 bp, Homo sapiens; identical to SEQ ID NO: 85

SEQ ID NO: 31546 - DNA, 203 bp, Homo sapiens; identical to SEQ ID NO: 87

SEQ ID NO: 31547 - DNA, 203 bp, Homo sapiens; identical to SEQ ID NO: 99

SEQ ID NO: 31548 - DNA, 203 bp, Homo sapiens; identical to SEQ ID NO: 109

SEQ ID NO: 31549 - DNA, 203 bp, Homo sapiens; identical to SEQ ID NO: 110

SEQ ID NO: 31550 - DNA, 203 bp, Homo sapiens; identical to SEQ ID NO: 111

SEQ ID NO: 31551 - DNA, 203 bp, Homo sapiens; identical to SEQ ID NO: 129

SEQ ID NO: 31552 - DNA, 203 bp, Homo sapiens; identical to SEQ ID NO: 139

SEQ ID NO: 31553 - DNA, 203 bp, Homo sapiens; identical to SEQ ID NO: 142

SEQ ID NO: 31554 - DNA, 203 bp, Homo sapiens; identical to SEQ ID NO: 151

SEQ ID NO: 31555 - DNA, 203 bp, Homo sapiens; identical to SEQ ID NO: 166

SEQ ID NO: 31556 - DNA, 203 bp, Homo sapiens; identical to SEQ ID NO: 175

SEQ ID NO: 31557 - DNA, 203 bp, Homo sapiens; identical to SEQ ID NO: 176

SEQ ID NO: 31558 - DNA, 203 bp, Homo sapiens; identical to SEQ ID NO: 177

SEQ ID NO: 31559 - DNA, 203 bp, Homo sapiens; identical to SEQ ID NO: 197

SEQ ID NO: 31560 - DNA, 203 bp, Homo sapiens; identical to SEQ ID NO: 201

SEQ ID NO: 31561 - DNA, 203 bp, Homo sapiens; identical to SEQ ID NO: 207

SEQ ID NO: 31562 - DNA, 203 bp, Homo sapiens; identical to SEQ ID NO: 8852

SEQ ID NO: 31563 - DNA, 203 bp, Homo sapiens; identical to SEQ ID NO: 8853

SEQ ID NO: 31564 - DNA, 203 bp, Homo sapiens; identical to SEQ ID NO: 8855

SEQ ID NO: 31565 - DNA, 203 bp, Homo sapiens; identical to SEQ ID NO: 8858

SEQ ID NO: 31566 - DNA, 203 bp, Homo sapiens; identical to SEQ ID NO: 8864

SEQ ID NO: 31567 - DNA, 203 bp, Homo sapiens; identical to SEQ ID NO: 8865

SEQ ID NO: 31568 - DNA, 203 bp, Homo sapiens; identical to SEQ ID NO: 8882

SEQ ID NO: 31569 - DNA, 203 bp, Homo sapiens; identical to SEQ ID NO: 8900

SEQ ID NO: 31570 - DNA, 203 bp, Homo sapiens; identical to SEQ ID NO: 8920

SEQ ID NO: 31571 - DNA, 203 bp, Homo sapiens; identical to SEQ ID NO: 8921

SEQ ID NO: 31572 - DNA, 203 bp, Homo sapiens; identical to SEQ ID NO: 8922

SEQ ID NO: 31573 - DNA, 203 bp, Homo sapiens; identical to SEQ ID NO: 8924

SEQ ID NO: 31574 - DNA, 203 bp, Homo sapiens; identical to SEQ ID NO: 8925

SEQ ID NO: 31575 - DNA, 203 bp, Homo sapiens; identical to SEQ ID NO: 8926

SEQ ID NO: 31576 - DNA, 203 bp, Homo sapiens; identical to SEQ ID NO: 8927

SEQ ID NO: 31577 - DNA, 203 bp, Homo sapiens; identical to SEQ ID NO: 8928

SEQ ID NO: 31578 - DNA, 203 bp, Homo sapiens; identical to SEQ ID NO: 8929

SEQ ID NO: 31579 - DNA, 203 bp, Homo sapiens; identical to SEQ ID NO: 8930

SEQ ID NO: 31580 - DNA, 203 bp, Homo sapiens; identical to SEQ ID NO: 8931

SEQ ID NO: 31581 - DNA, 203 bp, Homo sapiens; identical to SEQ ID NO: 8932

SEQ ID NO: 31582 - DNA, 203 bp, Homo sapiens; identical to SEQ ID NO: 8936

SEQ ID NO: 31583 - DNA, 203 bp, Homo sapiens; identical to SEQ ID NO: 8946

SEQ ID NO: 31584 - DNA, 203 bp, Homo sapiens; identical to SEQ ID NO: 8955

SEQ ID NO: 31585 - DNA, 203 bp, Homo sapiens; identical to SEQ ID NO: 8971

SEQ ID NO: 31586 - DNA, 203 bp, Homo sapiens; identical to SEQ ID NO: 8975

SEQ ID NO: 31587 - DNA, 203 bp, Homo sapiens; identical to SEQ ID NO: 8978

SEQ ID NO: 31588 - DNA, 203 bp, Homo sapiens; identical to SEQ ID NO: 8979

SEQ ID NO: 31589 - DNA, 203 bp, Homo sapiens; identical to SEQ ID NO: 8982

SEQ ID NO: 31590 - DNA, 203 bp, Homo sapiens; identical to SEQ ID NO: 8983

SEQ ID NO: 31591 - DNA, 203 bp, Homo sapiens; identical to SEQ ID NO: 8984

SEQ ID NO: 31592 - DNA, 203 bp, Homo sapiens; identical to SEQ ID NO: 8985

SEQ ID NO: 31593 - DNA, 203 bp, Homo sapiens; identical to SEQ ID NO: 8987

SEQ ID NO: 31594 - DNA, 203 bp, Homo sapiens; identical to SEQ ID NO: 8992

SEQ ID NO: 31595 - DNA, 203 bp, Homo sapiens; identical to SEQ ID NO: 8994

SEQ ID NO: 31596 - DNA, 203 bp, Homo sapiens; identical to SEQ ID NO: 8995

SEQ ID NO: 31597 - DNA, 203 bp, Homo sapiens; identical to SEQ ID NO: 8996

SEQ ID NO: 31598 - DNA, 203 bp, Homo sapiens; identical to SEQ ID NO: 8997

SEQ ID NO: 31599 - DNA, 203 bp, Homo sapiens; identical to SEQ ID NO: 8998

SEQ ID NO: 31600 - DNA, 203 bp, Homo sapiens; identical to SEQ ID NO: 8999

SEQ ID NO: 31601 - DNA, 203 bp, Homo sapiens; identical to SEQ ID NO: 9001

SEQ ID NO: 31602 - DNA, 203 bp, Homo sapiens; identical to SEQ ID NO: 9004

SEQ ID NO: 31603 - DNA, 203 bp, Homo sapiens; identical to SEQ ID NO: 9008

SEQ ID NO: 31604 - DNA, 203 bp, Homo sapiens; identical to SEQ ID NO: 9011

SEQ ID NO: 31605 - DNA, 203 bp, Homo sapiens; identical to SEQ ID NO: 9012

SEQ ID NO: 31606 - DNA, 203 bp, Homo sapiens; identical to SEQ ID NO: 9015

SEQ ID NO: 31607 - DNA, 203 bp, Homo sapiens; identical to SEQ ID NO: 9017

SEQ ID NO: 31608 - DNA, 203 bp, Homo sapiens; identical to SEQ ID NO: 9019

SEQ ID NO: 31609 - DNA, 203 bp, Homo sapiens; identical to SEQ ID NO: 9026

SEQ ID NO: 31610 - DNA, 203 bp, Homo sapiens; identical to SEQ ID NO: 9029

SEQ ID NO: 31611 - DNA, 203 bp, Homo sapiens; identical to SEQ ID NO: 9031

SEQ ID NO: 31612 - DNA, 203 bp, Homo sapiens; identical to SEQ ID NO: 9032

SEQ ID NO: 31613 - DNA, 203 bp, Homo sapiens; identical to SEQ ID NO: 9033

SEQ ID NO: 31614 - DNA, 203 bp, Homo sapiens; identical to SEQ ID NO: 9034

SEQ ID NO: 31615 - DNA, 203 bp, Homo sapiens; identical to SEQ ID NO: 9035

SEQ ID NO: 31616 - DNA, 203 bp, Homo sapiens; identical to SEQ ID NO: 9036

SEQ ID NO: 31617 - DNA, 203 bp, Homo sapiens; identical to SEQ ID NO: 9042

SEQ ID NO: 31618 - DNA, 203 bp, Homo sapiens; identical to SEQ ID NO: 9045

SEQ ID NO: 31619 - DNA, 203 bp, Homo sapiens; identical to SEQ ID NO: 9049

SEQ ID NO: 31620 - DNA, 203 bp, Homo sapiens; identical to SEQ ID NO: 9051

SEQ ID NO: 31621 - DNA, 203 bp, Homo sapiens; identical to SEQ ID NO: 9053

SEQ ID NO: 31622 - DNA, 203 bp, Homo sapiens; identical to SEQ ID NO: 9054

SEQ ID NO: 31623 - DNA, 203 bp, Homo sapiens; identical to SEQ ID NO: 9055

SEQ ID NO: 31624 - DNA, 203 bp, Homo sapiens; identical to SEQ ID NO: 9059

SEQ ID NO: 31625 - DNA, 203 bp, Homo sapiens; identical to SEQ ID NO: 9061

SEQ ID NO: 31626 - DNA, 203 bp, Homo sapiens; identical to SEQ ID NO: 9063

SEQ ID NO: 31627 - DNA, 203 bp, Homo sapiens; identical to SEQ ID NO: 9068

SEQ ID NO: 31628 - DNA, 203 bp, Homo sapiens; identical to SEQ ID NO: 9072

SEQ ID NO: 31629 - DNA, 203 bp, Homo sapiens; identical to SEQ ID NO: 9079

SEQ ID NO: 31630 - DNA, 203 bp, Homo sapiens; identical to SEQ ID NO: 9080

SEQ ID NO: 31631 - DNA, 203 bp, Homo sapiens; identical to SEQ ID NO: 9082

SEQ ID NO: 31632 - DNA, 203 bp, Homo sapiens; identical to SEQ ID NO: 9084

SEQ ID NO: 31633 - DNA, 203 bp, Homo sapiens; identical to SEQ ID NO: 9088

SEQ ID NO: 31634 - DNA, 203 bp, Homo sapiens; identical to SEQ ID NO: 9089

SEQ ID NO: 31635 - DNA, 203 bp, Homo sapiens; identical to SEQ ID NO: 9092

SEQ ID NO: 31636 - DNA, 203 bp, Homo sapiens; identical to SEQ ID NO: 9095

SEQ ID NO: 31637 - DNA, 203 bp, Homo sapiens; identical to SEQ ID NO: 9096

SEQ ID NO: 31638 - DNA, 203 bp, Homo sapiens; identical to SEQ ID NO: 9103

SEQ ID NO: 31639 - DNA, 203 bp, Homo sapiens; identical to SEQ ID NO: 9104

SEQ ID NO: 31640 - DNA, 203 bp, Homo sapiens; identical to SEQ ID NO: 9109

SEQ ID NO: 31641 - DNA, 203 bp, Homo sapiens; identical to SEQ ID NO: 9111

SEQ ID NO: 31642 - DNA, 203 bp, Homo sapiens; identical to SEQ ID NO: 9112

SEQ ID NO: 31643 - DNA, 203 bp, Homo sapiens; identical to SEQ ID NO: 9113

SEQ ID NO: 31644 - DNA, 203 bp, Homo sapiens; identical to SEQ ID NO: 9116

SEQ ID NO: 31645 - DNA, 203 bp, Homo sapiens; identical to SEQ ID NO: 9117

SEQ ID NO: 31646 - DNA, 203 bp, Homo sapiens; identical to SEQ ID NO: 9119

SEQ ID NO: 31647 - DNA, 203 bp, Homo sapiens; identical to SEQ ID NO: 9122

SEQ ID NO: 31648 - DNA, 203 bp, Homo sapiens; identical to SEQ ID NO: 9127

SEQ ID NO: 31649 - DNA, 203 bp, Homo sapiens; identical to SEQ ID NO: 9132

SEQ ID NO: 31650 - DNA, 203 bp, Homo sapiens; identical to SEQ ID NO: 9134

SEQ ID NO: 31651 - DNA, 203 bp, Homo sapiens; identical to SEQ ID NO: 9136

SEQ ID NO: 31652 - DNA, 203 bp, Homo sapiens; identical to SEQ ID NO: 9139

SEQ ID NO: 31653 - DNA, 203 bp, Homo sapiens; identical to SEQ ID NO: 9142

SEQ ID NO: 31654 - DNA, 203 bp, Homo sapiens; identical to SEQ ID NO: 9149

SEQ ID NO: 31655 - DNA, 203 bp, Homo sapiens; identical to SEQ ID NO: 9155

SEQ ID NO: 31656 - DNA, 203 bp, Homo sapiens; identical to SEQ ID NO: 9156

SEQ ID NO: 31657 - DNA, 203 bp, Homo sapiens; identical to SEQ ID NO: 9157

SEQ ID NO: 31658 - DNA, 203 bp, Homo sapiens; identical to SEQ ID NO: 9168

SEQ ID NO: 31659 - DNA, 203 bp, Homo sapiens; identical to SEQ ID NO: 9174

SEQ ID NO: 31660 - DNA, 203 bp, Homo sapiens; identical to SEQ ID NO: 9176

SEQ ID NO: 31661 - DNA, 203 bp, Homo sapiens; identical to SEQ ID NO: 9177

SEQ ID NO: 31662 - DNA, 203 bp, Homo sapiens; identical to SEQ ID NO: 9178

SEQ ID NO: 31663 - DNA, 203 bp, Homo sapiens; identical to SEQ ID NO: 9181

SEQ ID NO: 31664 - DNA, 203 bp, Homo sapiens; identical to SEQ ID NO: 9182

SEQ ID NO: 31665 - DNA, 203 bp, Homo sapiens; identical to SEQ ID NO: 9185

SEQ ID NO: 31666 - DNA, 203 bp, Homo sapiens; identical to SEQ ID NO: 9186

SEQ ID NO: 31667 - DNA, 203 bp, Homo sapiens; identical to SEQ ID NO: 9188

SEQ ID NO: 31668 - DNA, 203 bp, Homo sapiens; identical to SEQ ID NO: 9190

SEQ ID NO: 31669 - DNA, 203 bp, Homo sapiens; identical to SEQ ID NO: 9191

SEQ ID NO: 31670 - DNA, 203 bp, Homo sapiens; identical to SEQ ID NO: 9195

SEQ ID NO: 31671 - DNA, 203 bp, Homo sapiens; identical to SEQ ID NO: 9198

SEQ ID NO: 31672 - DNA, 203 bp, Homo sapiens; identical to SEQ ID NO: 9211

SEQ ID NO: 31673 - DNA, 203 bp, Homo sapiens; identical to SEQ ID NO: 9221

SEQ ID NO: 31674 - DNA, 203 bp, Homo sapiens; identical to SEQ ID NO: 9225

SEQ ID NO: 31675 - DNA, 203 bp, Homo sapiens; identical to SEQ ID NO: 9229

SEQ ID NO: 31676 - DNA, 203 bp, Homo sapiens; identical to SEQ ID NO: 9232

SEQ ID NO: 31677 - DNA, 203 bp, Homo sapiens; identical to SEQ ID NO: 9235

SEQ ID NO: 31678 - DNA, 203 bp, Homo sapiens; identical to SEQ ID NO: 9242

SEQ ID NO: 31679 - DNA, 203 bp, Homo sapiens; identical to SEQ ID NO: 9244

SEQ ID NO: 31680 - DNA, 203 bp, Homo sapiens; identical to SEQ ID NO: 9246

SEQ ID NO: 31681 - DNA, 203 bp, Homo sapiens; identical to SEQ ID NO: 9252

SEQ ID NO: 31682 - DNA, 203 bp, Homo sapiens; identical to SEQ ID NO: 9254

SEQ ID NO: 31683 - DNA, 203 bp, Homo sapiens; identical to SEQ ID NO: 9255

SEQ ID NO: 31684 - DNA, 203 bp, Homo sapiens; identical to SEQ ID NO: 9257

SEQ ID NO: 31685 - DNA, 203 bp, Homo sapiens; identical to SEQ ID NO: 9259

SEQ ID NO: 31686 - DNA, 203 bp, Homo sapiens; identical to SEQ ID NO: 9262

SEQ ID NO: 31687 - DNA, 203 bp, Homo sapiens; identical to SEQ ID NO: 9264

SEQ ID NO: 31688 - DNA, 203 bp, Homo sapiens; identical to SEQ ID NO: 9265

SEQ ID NO: 31689 - DNA, 203 bp, Homo sapiens; identical to SEQ ID NO: 9266

SEQ ID NO: 31690 - DNA, 203 bp, Homo sapiens; identical to SEQ ID NO: 9271

SEQ ID NO: 31691 - DNA, 203 bp, Homo sapiens; identical to SEQ ID NO: 9272

SEQ ID NO: 31692 - DNA, 203 bp, Homo sapiens; identical to SEQ ID NO: 9274

SEQ ID NO: 31693 - DNA, 203 bp, Homo sapiens; identical to SEQ ID NO: 9276

SEQ ID NO: 31694 - DNA, 203 bp, Homo sapiens; identical to SEQ ID NO: 9283

SEQ ID NO: 31695 - DNA, 203 bp, Homo sapiens; identical to SEQ ID NO: 9284

SEQ ID NO: 31696 - DNA, 203 bp, Homo sapiens; identical to SEQ ID NO: 9288

SEQ ID NO: 31697 - DNA, 203 bp, Homo sapiens; identical to SEQ ID NO: 9289

SEQ ID NO: 31698 - DNA, 203 bp, Homo sapiens; identical to SEQ ID NO: 9291

SEQ ID NO: 31699 - DNA, 203 bp, Homo sapiens; identical to SEQ ID NO: 9294

SEQ ID NO: 31700 - DNA, 203 bp, Homo sapiens; identical to SEQ ID NO: 9296

SEQ ID NO: 31701 - DNA, 203 bp, Homo sapiens; identical to SEQ ID NO: 9298

SEQ ID NO: 31702 - DNA, 203 bp, Homo sapiens; identical to SEQ ID NO: 9300

SEQ ID NO: 31703 - DNA, 203 bp, Homo sapiens; identical to SEQ ID NO: 9302

SEQ ID NO: 31704 - DNA, 203 bp, Homo sapiens; identical to SEQ ID NO: 9306

SEQ ID NO: 31705 - DNA, 203 bp, Homo sapiens; identical to SEQ ID NO: 9308

SEQ ID NO: 31706 - DNA, 203 bp, Homo sapiens; identical to SEQ ID NO: 9309

SEQ ID NO: 31707 - DNA, 203 bp, Homo sapiens; identical to SEQ ID NO: 9313

SEQ ID NO: 31708 - DNA, 203 bp, Homo sapiens; identical to SEQ ID NO: 9319

SEQ ID NO: 31709 - DNA, 203 bp, Homo sapiens; identical to SEQ ID NO: 9320

SEQ ID NO: 31710 - DNA, 203 bp, Homo sapiens; identical to SEQ ID NO: 9322

SEQ ID NO: 31711 - DNA, 203 bp, Homo sapiens; identical to SEQ ID NO: 9324

SEQ ID NO: 31712 - DNA, 203 bp, Homo sapiens; identical to SEQ ID NO: 9335

SEQ ID NO: 31713 - DNA, 203 bp, Homo sapiens; identical to SEQ ID NO: 9343

SEQ ID NO: 31714 - DNA, 203 bp, Homo sapiens; identical to SEQ ID NO: 9347

SEQ ID NO: 31715 - DNA, 203 bp, Homo sapiens; identical to SEQ ID NO: 9348

SEQ ID NO: 31716 - DNA, 203 bp, Homo sapiens; identical to SEQ ID NO: 9353

SEQ ID NO: 31717 - DNA, 203 bp, Homo sapiens; identical to SEQ ID NO: 9354

SEQ ID NO: 31718 - DNA, 203 bp, Homo sapiens; identical to SEQ ID NO: 9358

SEQ ID NO: 31719 - DNA, 203 bp, Homo sapiens; identical to SEQ ID NO: 9373

SEQ ID NO: 31720 - DNA, 203 bp, Homo sapiens; identical to SEQ ID NO: 9377

SEQ ID NO: 31721 - DNA, 203 bp, Homo sapiens; identical to SEQ ID NO: 9378

SEQ ID NO: 31722 - DNA, 203 bp, Homo sapiens; identical to SEQ ID NO: 9379

SEQ ID NO: 31723 - DNA, 203 bp, Homo sapiens; identical to SEQ ID NO: 9380

SEQ ID NO: 31724 - DNA, 203 bp, Homo sapiens; identical to SEQ ID NO: 9381

SEQ ID NO: 31725 - DNA, 203 bp, Homo sapiens; identical to SEQ ID NO: 9384

SEQ ID NO: 31726 - DNA, 203 bp, Homo sapiens; identical to SEQ ID NO: 9391

SEQ ID NO: 31727 - DNA, 203 bp, Homo sapiens; identical to SEQ ID NO: 9392

SEQ ID NO: 31728 - DNA, 203 bp, Homo sapiens; identical to SEQ ID NO: 9397

SEQ ID NO: 31729 - DNA, 203 bp, Homo sapiens; identical to SEQ ID NO: 9398

SEQ ID NO: 31730 - DNA, 203 bp, Homo sapiens; identical to SEQ ID NO: 9400

SEQ ID NO: 31731 - DNA, 203 bp, Homo sapiens; identical to SEQ ID NO: 9404

SEQ ID NO: 31732 - DNA, 203 bp, Homo sapiens; identical to SEQ ID NO: 9406

SEQ ID NO: 31733 - DNA, 203 bp, Homo sapiens; identical to SEQ ID NO: 9416

SEQ ID NO: 31734 - DNA, 203 bp, Homo sapiens; identical to SEQ ID NO: 9423

SEQ ID NO: 31735 - DNA, 203 bp, Homo sapiens; identical to SEQ ID NO: 9425

SEQ ID NO: 31736 - DNA, 203 bp, Homo sapiens; identical to SEQ ID NO: 9442

SEQ ID NO: 31737 - DNA, 203 bp, Homo sapiens; identical to SEQ ID NO: 9444

SEQ ID NO: 31738 - DNA, 203 bp, Homo sapiens; identical to SEQ ID NO: 9445

SEQ ID NO: 31739 - DNA, 203 bp, Homo sapiens; identical to SEQ ID NO: 9501

SEQ ID NO: 31740 - DNA, 203 bp, Homo sapiens; identical to SEQ ID NO: 9502

SEQ ID NO: 31741 - DNA, 203 bp, Homo sapiens; identical to SEQ ID NO: 9503

SEQ ID NO: 31742 - DNA, 203 bp, Homo sapiens; identical to SEQ ID NO: 9504

SEQ ID NO: 31743 - DNA, 203 bp, Homo sapiens; identical to SEQ ID NO: 9510

SEQ ID NO: 31744 - DNA, 203 bp, Homo sapiens; identical to SEQ ID NO: 9511

SEQ ID NO: 31745 - DNA, 203 bp, Homo sapiens; identical to SEQ ID NO: 9512

SEQ ID NO: 31746 - DNA, 203 bp, Homo sapiens; identical to SEQ ID NO: 9522

SEQ ID NO: 31747 - DNA, 203 bp, Homo sapiens; identical to SEQ ID NO: 9536

SEQ ID NO: 31748 - DNA, 203 bp, Homo sapiens; identical to SEQ ID NO: 9537

SEQ ID NO: 31749 - DNA, 203 bp, Homo sapiens; identical to SEQ ID NO: 9538

SEQ ID NO: 31750 - DNA, 203 bp, Homo sapiens; identical to SEQ ID NO: 9539

SEQ ID NO: 31751 - DNA, 203 bp, Homo sapiens; identical to SEQ ID NO: 9550

SEQ ID NO: 31752 - DNA, 203 bp, Homo sapiens; identical to SEQ ID NO: 9551

SEQ ID NO: 31753 - DNA, 203 bp, Homo sapiens; identical to SEQ ID NO: 9552

SEQ ID NO: 31754 - DNA, 203 bp, Homo sapiens; identical to SEQ ID NO: 9569

SEQ ID NO: 31755 - DNA, 203 bp, Homo sapiens; identical to SEQ ID NO: 9570

SEQ ID NO: 31756 - DNA, 203 bp, Homo sapiens; identical to SEQ ID NO: 9571

SEQ ID NO: 31757 - DNA, 203 bp, Homo sapiens; identical to SEQ ID NO: 9572

SEQ ID NO: 31758 - DNA, 203 bp, Homo sapiens; identical to SEQ ID NO: 9573

SEQ ID NO: 31759 - DNA, 203 bp, Homo sapiens; identical to SEQ ID NO: 9574

SEQ ID NO: 31760 - DNA, 203 bp, Homo sapiens; identical to SEQ ID NO: 9575

SEQ ID NO: 31761 - DNA, 203 bp, Homo sapiens; identical to SEQ ID NO: 9576

SEQ ID NO: 31762 - DNA, 203 bp, Homo sapiens; identical to SEQ ID NO: 9577

SEQ ID NO: 31763 - DNA, 203 bp, Homo sapiens; identical to SEQ ID NO: 9578

SEQ ID NO: 31764 - DNA, 203 bp, Homo sapiens; identical to SEQ ID NO: 9579

SEQ ID NO: 31765 - DNA, 203 bp, Homo sapiens; identical to SEQ ID NO: 9581

SEQ ID NO: 31766 - DNA, 203 bp, Homo sapiens; identical to SEQ ID NO: 9582

SEQ ID NO: 31767 - DNA, 203 bp, Homo sapiens; identical to SEQ ID NO: 9583

SEQ ID NO: 31768 - DNA, 203 bp, Homo sapiens; identical to SEQ ID NO: 9584

SEQ ID NO: 31769 - DNA, 203 bp, Homo sapiens; identical to SEQ ID NO: 9585

SEQ ID NO: 31770 - DNA, 203 bp, Homo sapiens; identical to SEQ ID NO: 9586

SEQ ID NO: 31771 - DNA, 203 bp, Homo sapiens; identical to SEQ ID NO: 9587

SEQ ID NO: 31772 - DNA, 203 bp, Homo sapiens; identical to SEQ ID NO: 9588

SEQ ID NO: 31773 - DNA, 203 bp, Homo sapiens; identical to SEQ ID NO: 9600

SEQ ID NO: 31774 - DNA, 203 bp, Homo sapiens; identical to SEQ ID NO: 9601

SEQ ID NO: 31775 - DNA, 203 bp, Homo sapiens; identical to SEQ ID NO: 9607

SEQ ID NO: 31776 - DNA, 203 bp, Homo sapiens; identical to SEQ ID NO: 9608

SEQ ID NO: 31777 - DNA, 203 bp, Homo sapiens; identical to SEQ ID NO: 9609

SEQ ID NO: 31778 - DNA, 203 bp, Homo sapiens; identical to SEQ ID NO: 9610

SEQ ID NO: 31779 - DNA, 203 bp, Homo sapiens; identical to SEQ ID NO: 9611

SEQ ID NO: 31780 - DNA, 203 bp, Homo sapiens; identical to SEQ ID NO: 9616

SEQ ID NO: 31781 - DNA, 203 bp, Homo sapiens; identical to SEQ ID NO: 9622

SEQ ID NO: 31782 - DNA, 203 bp, Homo sapiens; identical to SEQ ID NO: 9629

SEQ ID NO: 31783 - DNA, 203 bp, Homo sapiens; identical to SEQ ID NO: 9632

SEQ ID NO: 31784 - DNA, 203 bp, Homo sapiens; identical to SEQ ID NO: 9636

SEQ ID NO: 31785 - DNA, 203 bp, Homo sapiens; identical to SEQ ID NO: 9637

SEQ ID NO: 31786 - DNA, 203 bp, Homo sapiens; identical to SEQ ID NO: 9639

SEQ ID NO: 31787 - DNA, 203 bp, Homo sapiens; identical to SEQ ID NO: 9641

SEQ ID NO: 31788 - DNA, 203 bp, Homo sapiens; identical to SEQ ID NO: 9642

SEQ ID NO: 31789 - DNA, 203 bp, Homo sapiens; identical to SEQ ID NO: 9647

SEQ ID NO: 31790 - DNA, 203 bp, Homo sapiens; identical to SEQ ID NO: 9649

SEQ ID NO: 31791 - DNA, 203 bp, Homo sapiens; identical to SEQ ID NO: 9655

SEQ ID NO: 31792 - DNA, 203 bp, Homo sapiens; identical to SEQ ID NO: 9657

SEQ ID NO: 31793 - DNA, 203 bp, Homo sapiens; identical to SEQ ID NO: 9658

SEQ ID NO: 31794 - DNA, 203 bp, Homo sapiens; identical to SEQ ID NO: 9664

SEQ ID NO: 31795 - DNA, 203 bp, Homo sapiens; identical to SEQ ID NO: 9665

SEQ ID NO: 31796 - DNA, 203 bp, Homo sapiens; identical to SEQ ID NO: 9671

SEQ ID NO: 31797 - DNA, 203 bp, Homo sapiens; identical to SEQ ID NO: 9678

SEQ ID NO: 31798 - DNA, 203 bp, Homo sapiens; identical to SEQ ID NO: 9682

SEQ ID NO: 31799 - DNA, 203 bp, Homo sapiens; identical to SEQ ID NO: 9683

SEQ ID NO: 31800 - DNA, 203 bp, Homo sapiens; identical to SEQ ID NO: 9685

SEQ ID NO: 31801 - DNA, 203 bp, Homo sapiens; identical to SEQ ID NO: 9687

SEQ ID NO: 31802 - DNA, 203 bp, Homo sapiens; identical to SEQ ID NO: 9689

SEQ ID NO: 31803 - DNA, 203 bp, Homo sapiens; identical to SEQ ID NO: 9692

SEQ ID NO: 31804 - DNA, 203 bp, Homo sapiens; identical to SEQ ID NO: 9695

SEQ ID NO: 31805 - DNA, 203 bp, Homo sapiens; identical to SEQ ID NO: 9697

SEQ ID NO: 31806 - DNA, 203 bp, Homo sapiens; identical to SEQ ID NO: 9700

SEQ ID NO: 31807 - DNA, 203 bp, Homo sapiens; identical to SEQ ID NO: 9707

SEQ ID NO: 31808 - DNA, 203 bp, Homo sapiens; identical to SEQ ID NO: 9708

SEQ ID NO: 31809 - DNA, 203 bp, Homo sapiens; identical to SEQ ID NO: 9709

SEQ ID NO: 31810 - DNA, 203 bp, Homo sapiens; identical to SEQ ID NO: 9713

SEQ ID NO: 31811 - DNA, 203 bp, Homo sapiens; identical to SEQ ID NO: 9718

SEQ ID NO: 31812 - DNA, 203 bp, Homo sapiens; identical to SEQ ID NO: 9719

SEQ ID NO: 31813 - DNA, 203 bp, Homo sapiens; identical to SEQ ID NO: 9720

SEQ ID NO: 31814 - DNA, 203 bp, Homo sapiens; identical to SEQ ID NO: 9722

SEQ ID NO: 31815 - DNA, 203 bp, Homo sapiens; identical to SEQ ID NO: 9726

SEQ ID NO: 31816 - DNA, 203 bp, Homo sapiens; identical to SEQ ID NO: 9728

SEQ ID NO: 31817 - DNA, 203 bp, Homo sapiens; identical to SEQ ID NO: 9730

SEQ ID NO: 31818 - DNA, 203 bp, Homo sapiens; identical to SEQ ID NO: 9734

SEQ ID NO: 31819 - DNA, 203 bp, Homo sapiens; identical to SEQ ID NO: 9741

SEQ ID NO: 31820 - DNA, 203 bp, Homo sapiens; identical to SEQ ID NO: 9742

SEQ ID NO: 31821 - DNA, 203 bp, Homo sapiens; identical to SEQ ID NO: 9744

SEQ ID NO: 31822 - DNA, 203 bp, Homo sapiens; identical to SEQ ID NO: 9751

SEQ ID NO: 31823 - DNA, 203 bp, Homo sapiens; identical to SEQ ID NO: 9759

SEQ ID NO: 31824 - DNA, 203 bp, Homo sapiens; identical to SEQ ID NO: 9760

SEQ ID NO: 31825 - DNA, 203 bp, Homo sapiens; identical to SEQ ID NO: 9766

SEQ ID NO: 31826 - DNA, 203 bp, Homo sapiens; identical to SEQ ID NO: 9770

SEQ ID NO: 31827 - DNA, 203 bp, Homo sapiens; identical to SEQ ID NO: 9789

SEQ ID NO: 31828 - DNA, 203 bp, Homo sapiens; identical to SEQ ID NO: 9792

SEQ ID NO: 31829 - DNA, 203 bp, Homo sapiens; identical to SEQ ID NO: 9794

SEQ ID NO: 31830 - DNA, 203 bp, Homo sapiens; identical to SEQ ID NO: 9796

SEQ ID NO: 31831 - DNA, 203 bp, Homo sapiens; identical to SEQ ID NO: 9805

SEQ ID NO: 31832 - DNA, 203 bp, Homo sapiens; identical to SEQ ID NO: 9812

SEQ ID NO: 31833 - DNA, 203 bp, Homo sapiens; identical to SEQ ID NO: 9814

SEQ ID NO: 31834 - DNA, 203 bp, Homo sapiens; identical to SEQ ID NO: 9816

SEQ ID NO: 31835 - DNA, 203 bp, Homo sapiens; identical to SEQ ID NO: 9818

SEQ ID NO: 31836 - DNA, 203 bp, Homo sapiens; identical to SEQ ID NO: 9820

SEQ ID NO: 31837 - DNA, 203 bp, Homo sapiens; identical to SEQ ID NO: 9821

SEQ ID NO: 31838 - DNA, 203 bp, Homo sapiens; identical to SEQ ID NO: 9832

SEQ ID NO: 31839 - DNA, 203 bp, Homo sapiens; identical to SEQ ID NO: 9833

SEQ ID NO: 31840 - DNA, 203 bp, Homo sapiens; identical to SEQ ID NO: 9834

SEQ ID NO: 31841 - DNA, 203 bp, Homo sapiens; identical to SEQ ID NO: 9836

SEQ ID NO: 31842 - DNA, 203 bp, Homo sapiens; identical to SEQ ID NO: 9841

SEQ ID NO: 31843 - DNA, 203 bp, Homo sapiens; identical to SEQ ID NO: 9844

SEQ ID NO: 31844 - DNA, 203 bp, Homo sapiens; identical to SEQ ID NO: 9846

SEQ ID NO: 31845 - DNA, 203 bp, Homo sapiens; identical to SEQ ID NO: 9850

SEQ ID NO: 31846 - DNA, 203 bp, Homo sapiens; identical to SEQ ID NO: 9859

SEQ ID NO: 31847 - DNA, 203 bp, Homo sapiens; identical to SEQ ID NO: 9860

SEQ ID NO: 31848 - DNA, 203 bp, Homo sapiens; identical to SEQ ID NO: 9861

SEQ ID NO: 31849 - DNA, 203 bp, Homo sapiens; identical to SEQ ID NO: 9863

SEQ ID NO: 31850 - DNA, 203 bp, Homo sapiens; identical to SEQ ID NO: 9865

SEQ ID NO: 31851 - DNA, 203 bp, Homo sapiens; identical to SEQ ID NO: 9866

SEQ ID NO: 31852 - DNA, 203 bp, Homo sapiens; identical to SEQ ID NO: 9869

SEQ ID NO: 31853 - DNA, 203 bp, Homo sapiens; identical to SEQ ID NO: 9870

SEQ ID NO: 31854 - DNA, 203 bp, Homo sapiens; identical to SEQ ID NO: 9877

SEQ ID NO: 31855 - DNA, 203 bp, Homo sapiens; identical to SEQ ID NO: 9879

SEQ ID NO: 31856 - DNA, 203 bp, Homo sapiens; identical to SEQ ID NO: 9886

SEQ ID NO: 31857 - DNA, 203 bp, Homo sapiens; identical to SEQ ID NO: 9887

SEQ ID NO: 31858 - DNA, 203 bp, Homo sapiens; identical to SEQ ID NO: 9888

SEQ ID NO: 31859 - DNA, 203 bp, Homo sapiens; identical to SEQ ID NO: 9891

SEQ ID NO: 31860 - DNA, 203 bp, Homo sapiens; identical to SEQ ID NO: 9892

SEQ ID NO: 31861 - DNA, 203 bp, Homo sapiens; identical to SEQ ID NO: 9893

SEQ ID NO: 31862 - DNA, 203 bp, Homo sapiens; identical to SEQ ID NO: 9894

SEQ ID NO: 31863 - DNA, 203 bp, Homo sapiens; identical to SEQ ID NO: 9896

SEQ ID NO: 31864 - DNA, 203 bp, Homo sapiens; identical to SEQ ID NO: 9902

SEQ ID NO: 31865 - DNA, 203 bp, Homo sapiens; identical to SEQ ID NO: 9908

SEQ ID NO: 31866 - DNA, 203 bp, Homo sapiens; identical to SEQ ID NO: 9910

SEQ ID NO: 31867 - DNA, 203 bp, Homo sapiens; identical to SEQ ID NO: 9913

SEQ ID NO: 31868 - DNA, 203 bp, Homo sapiens; identical to SEQ ID NO: 9921

SEQ ID NO: 31869 - DNA, 203 bp, Homo sapiens; identical to SEQ ID NO: 9997

SEQ ID NO: 31870 - DNA, 203 bp, Homo sapiens; identical to SEQ ID NO: 10081

SEQ ID NO: 31871 - DNA, 203 bp, Homo sapiens; identical to SEQ ID NO: 10095

SEQ ID NO: 31872 - DNA, 203 bp, Homo sapiens; identical to SEQ ID NO: 10096

SEQ ID NO: 31873 - DNA, 203 bp, Homo sapiens; identical to SEQ ID NO: 10097

SEQ ID NO: 31874 - DNA, 203 bp, Homo sapiens; identical to SEQ ID NO: 10098

SEQ ID NO: 31875 - DNA, 203 bp, Homo sapiens; identical to SEQ ID NO: 10099

SEQ ID NO: 31876 - DNA, 203 bp, Homo sapiens; identical to SEQ ID NO: 10100

SEQ ID NO: 31877 - DNA, 203 bp, Homo sapiens; identical to SEQ ID NO: 10107

SEQ ID NO: 31878 - DNA, 203 bp, Homo sapiens; identical to SEQ ID NO: 10108

SEQ ID NO: 31879 - DNA, 203 bp, Homo sapiens; identical to SEQ ID NO: 10109

SEQ ID NO: 31880 - DNA, 203 bp, Homo sapiens; identical to SEQ ID NO: 10110

SEQ ID NO: 31881 - DNA, 203 bp, Homo sapiens; identical to SEQ ID NO: 10213

SEQ ID NO: 31882 - DNA, 203 bp, Homo sapiens; identical to SEQ ID NO: 10214

SEQ ID NO: 31883 - DNA, 203 bp, Homo sapiens; identical to SEQ ID NO: 10215

SEQ ID NO: 31884 - DNA, 203 bp, Homo sapiens; identical to SEQ ID NO: 10216

SEQ ID NO: 31885 - DNA, 203 bp, Homo sapiens; identical to SEQ ID NO: 10219

SEQ ID NO: 31886 - DNA, 203 bp, Homo sapiens; identical to SEQ ID NO: 10225

SEQ ID NO: 31887 - DNA, 203 bp, Homo sapiens; identical to SEQ ID NO: 10234

SEQ ID NO: 31888 - DNA, 203 bp, Homo sapiens; identical to SEQ ID NO: 10235

SEQ ID NO: 31889 - DNA, 203 bp, Homo sapiens; identical to SEQ ID NO: 10236

SEQ ID NO: 31890 - DNA, 203 bp, Homo sapiens; identical to SEQ ID NO: 10250

SEQ ID NO: 31891 - DNA, 203 bp, Homo sapiens; identical to SEQ ID NO: 10251

SEQ ID NO: 31892 - DNA, 203 bp, Homo sapiens; identical to SEQ ID NO: 10252

SEQ ID NO: 31893 - DNA, 203 bp, Homo sapiens; identical to SEQ ID NO: 10275

SEQ ID NO: 31894 - DNA, 203 bp, Homo sapiens; identical to SEQ ID NO: 10276

SEQ ID NO: 31895 - DNA, 203 bp, Homo sapiens; identical to SEQ ID NO: 10277

SEQ ID NO: 31896 - DNA, 203 bp, Homo sapiens; identical to SEQ ID NO: 10278

SEQ ID NO: 31897 - DNA, 203 bp, Homo sapiens; identical to SEQ ID NO: 10281

SEQ ID NO: 31898 - DNA, 203 bp, Homo sapiens; identical to SEQ ID NO: 10286

SEQ ID NO: 31899 - DNA, 203 bp, Homo sapiens; identical to SEQ ID NO: 10287

SEQ ID NO: 31900 - DNA, 203 bp, Homo sapiens; identical to SEQ ID NO: 10288

SEQ ID NO: 31901 - DNA, 203 bp, Homo sapiens; identical to SEQ ID NO: 10292

SEQ ID NO: 31902 - DNA, 203 bp, Homo sapiens; identical to SEQ ID NO: 10293

SEQ ID NO: 31903 - DNA, 203 bp, Homo sapiens; identical to SEQ ID NO: 10294

SEQ ID NO: 31904 - DNA, 203 bp, Homo sapiens; identical to SEQ ID NO: 10295

SEQ ID NO: 31905 - DNA, 203 bp, Homo sapiens; identical to SEQ ID NO: 10296

SEQ ID NO: 31906 - DNA, 203 bp, Homo sapiens; identical to SEQ ID NO: 10297

SEQ ID NO: 31907 - DNA, 203 bp, Homo sapiens; identical to SEQ ID NO: 10302

SEQ ID NO: 31908 - DNA, 203 bp, Homo sapiens; identical to SEQ ID NO: 10303

SEQ ID NO: 31909 - DNA, 203 bp, Homo sapiens; identical to SEQ ID NO: 10304

SEQ ID NO: 31910 - DNA, 203 bp, Homo sapiens; identical to SEQ ID NO: 10305

SEQ ID NO: 31911 - DNA, 203 bp, Homo sapiens; identical to SEQ ID NO: 10306

SEQ ID NO: 31912 - DNA, 203 bp, Homo sapiens; identical to SEQ ID NO: 10307

SEQ ID NO: 31913 - DNA, 203 bp, Homo sapiens; identical to SEQ ID NO: 10308

SEQ ID NO: 31914 - DNA, 203 bp, Homo sapiens; identical to SEQ ID NO: 10309

SEQ ID NO: 31915 - DNA, 203 bp, Homo sapiens; identical to SEQ ID NO: 10310

SEQ ID NO: 31916 - DNA, 203 bp, Homo sapiens; identical to SEQ ID NO: 10311

SEQ ID NO: 31917 - DNA, 203 bp, Homo sapiens; identical to SEQ ID NO: 10313

SEQ ID NO: 31918 - DNA, 203 bp, Homo sapiens; identical to SEQ ID NO: 10316

SEQ ID NO: 31919 - DNA, 203 bp, Homo sapiens; identical to SEQ ID NO: 10319

SEQ ID NO: 31920 - DNA, 203 bp, Homo sapiens; identical to SEQ ID NO: 10320

SEQ ID NO: 31921 - DNA, 203 bp, Homo sapiens; identical to SEQ ID NO: 10322

SEQ ID NO: 31922 - DNA, 203 bp, Homo sapiens; identical to SEQ ID NO: 10323

SEQ ID NO: 31923 - DNA, 203 bp, Homo sapiens; identical to SEQ ID NO: 10324

SEQ ID NO: 31924 - DNA, 203 bp, Homo sapiens; identical to SEQ ID NO: 10325

SEQ ID NO: 31925 - DNA, 203 bp, Homo sapiens; identical to SEQ ID NO: 10327

SEQ ID NO: 31926 - DNA, 203 bp, Homo sapiens; identical to SEQ ID NO: 10328

SEQ ID NO: 31927 - DNA, 203 bp, Homo sapiens; identical to SEQ ID NO: 10329

SEQ ID NO: 31928 - DNA, 203 bp, Homo sapiens; identical to SEQ ID NO: 10343

SEQ ID NO: 31929 - DNA, 203 bp, Homo sapiens; identical to SEQ ID NO: 10344

SEQ ID NO: 31930 - DNA, 203 bp, Homo sapiens; identical to SEQ ID NO: 10345

SEQ ID NO: 31931 - DNA, 203 bp, Homo sapiens; identical to SEQ ID NO: 10346

SEQ ID NO: 31932 - DNA, 203 bp, Homo sapiens; identical to SEQ ID NO: 10347

SEQ ID NO: 31933 - DNA, 203 bp, Homo sapiens; identical to SEQ ID NO: 10348

SEQ ID NO: 31934 - DNA, 203 bp, Homo sapiens; identical to SEQ ID NO: 10349

SEQ ID NO: 31935 - DNA, 203 bp, Homo sapiens; identical to SEQ ID NO: 10350

SEQ ID NO: 31936 - DNA, 203 bp, Homo sapiens; identical to SEQ ID NO: 10351

SEQ ID NO: 31937 - DNA, 203 bp, Homo sapiens; identical to SEQ ID NO: 10352

SEQ ID NO: 31938 - DNA, 203 bp, Homo sapiens; identical to SEQ ID NO: 10353

SEQ ID NO: 31939 - DNA, 203 bp, Homo sapiens; identical to SEQ ID NO: 10357

SEQ ID NO: 31940 - DNA, 203 bp, Homo sapiens; identical to SEQ ID NO: 10358

SEQ ID NO: 31941 - DNA, 203 bp, Homo sapiens; identical to SEQ ID NO: 10359

SEQ ID NO: 31942 - DNA, 203 bp, Homo sapiens; identical to SEQ ID NO: 10372

SEQ ID NO: 31943 - DNA, 203 bp, Homo sapiens; identical to SEQ ID NO: 10373

SEQ ID NO: 31944 - DNA, 203 bp, Homo sapiens; identical to SEQ ID NO: 10374

SEQ ID NO: 31945 - DNA, 203 bp, Homo sapiens; identical to SEQ ID NO: 10377

SEQ ID NO: 31946 - DNA, 203 bp, Homo sapiens; identical to SEQ ID NO: 10378

SEQ ID NO: 31947 - DNA, 203 bp, Homo sapiens; identical to SEQ ID NO: 10379

SEQ ID NO: 31948 - DNA, 203 bp, Homo sapiens; identical to SEQ ID NO: 10382

SEQ ID NO: 31949 - DNA, 203 bp, Homo sapiens; identical to SEQ ID NO: 10383

SEQ ID NO: 31950 - DNA, 203 bp, Homo sapiens; identical to SEQ ID NO: 10384

SEQ ID NO: 31951 - DNA, 203 bp, Homo sapiens; identical to SEQ ID NO: 10386

SEQ ID NO: 31952 - DNA, 203 bp, Homo sapiens; identical to SEQ ID NO: 10387

SEQ ID NO: 31953 - DNA, 203 bp, Homo sapiens; identical to SEQ ID NO: 10388

SEQ ID NO: 31954 - DNA, 203 bp, Homo sapiens; identical to SEQ ID NO: 10408

SEQ ID NO: 31955 - DNA, 203 bp, Homo sapiens; identical to SEQ ID NO: 10409

SEQ ID NO: 31956 - DNA, 203 bp, Homo sapiens; identical to SEQ ID NO: 10410

SEQ ID NO: 31957 - DNA, 203 bp, Homo sapiens; identical to SEQ ID NO: 10416

SEQ ID NO: 31958 - DNA, 203 bp, Homo sapiens; identical to SEQ ID NO: 10417

SEQ ID NO: 31959 - DNA, 203 bp, Homo sapiens; identical to SEQ ID NO: 10426

SEQ ID NO: 31960 - DNA, 203 bp, Homo sapiens; identical to SEQ ID NO: 10428

SEQ ID NO: 31961 - DNA, 203 bp, Homo sapiens; identical to SEQ ID NO: 10448

SEQ ID NO: 31962 - DNA, 203 bp, Homo sapiens; identical to SEQ ID NO: 10454

SEQ ID NO: 31963 - DNA, 203 bp, Homo sapiens; identical to SEQ ID NO: 10462

SEQ ID NO: 31964 - DNA, 203 bp, Homo sapiens; identical to SEQ ID NO: 10465

SEQ ID NO: 31965 - DNA, 203 bp, Homo sapiens; identical to SEQ ID NO: 10469

SEQ ID NO: 31966 - DNA, 203 bp, Homo sapiens; identical to SEQ ID NO: 10472

SEQ ID NO: 31967 - DNA, 203 bp, Homo sapiens; identical to SEQ ID NO: 10473

SEQ ID NO: 31968 - DNA, 203 bp, Homo sapiens; identical to SEQ ID NO: 10481

SEQ ID NO: 31969 - DNA, 203 bp, Homo sapiens; identical to SEQ ID NO: 10482

SEQ ID NO: 31970 - DNA, 203 bp, Homo sapiens; identical to SEQ ID NO: 10485

SEQ ID NO: 31971 - DNA, 203 bp, Homo sapiens; identical to SEQ ID NO: 10486

SEQ ID NO: 31972 - DNA, 203 bp, Homo sapiens; identical to SEQ ID NO: 10490

SEQ ID NO: 31973 - DNA, 203 bp, Homo sapiens; identical to SEQ ID NO: 10494

SEQ ID NO: 31974 - DNA, 203 bp, Homo sapiens; identical to SEQ ID NO: 10495

SEQ ID NO: 31975 - DNA, 203 bp, Homo sapiens; identical to SEQ ID NO: 10496

SEQ ID NO: 31976 - DNA, 203 bp, Homo sapiens; identical to SEQ ID NO: 10497

SEQ ID NO: 31977 - DNA, 203 bp, Homo sapiens; identical to SEQ ID NO: 10500

SEQ ID NO: 31978 - DNA, 203 bp, Homo sapiens; identical to SEQ ID NO: 10502

SEQ ID NO: 31979 - DNA, 203 bp, Homo sapiens; identical to SEQ ID NO: 10505

SEQ ID NO: 31980 - DNA, 203 bp, Homo sapiens; identical to SEQ ID NO: 10507

SEQ ID NO: 31981 - DNA, 203 bp, Homo sapiens; identical to SEQ ID NO: 10513

SEQ ID NO: 31982 - DNA, 203 bp, Homo sapiens; identical to SEQ ID NO: 10525

SEQ ID NO: 31983 - DNA, 203 bp, Homo sapiens; identical to SEQ ID NO: 10534

SEQ ID NO: 31984 - DNA, 203 bp, Homo sapiens; identical to SEQ ID NO: 10539

SEQ ID NO: 31985 - DNA, 203 bp, Homo sapiens; identical to SEQ ID NO: 10597

SEQ ID NO: 31986 - DNA, 203 bp, Homo sapiens; identical to SEQ ID NO: 10603

SEQ ID NO: 31987 - DNA, 203 bp, Homo sapiens; identical to SEQ ID NO: 10604

SEQ ID NO: 31988 - DNA, 203 bp, Homo sapiens; identical to SEQ ID NO: 10624

SEQ ID NO: 31989 - DNA, 203 bp, Homo sapiens; identical to SEQ ID NO: 10625

SEQ ID NO: 31990 - DNA, 203 bp, Homo sapiens; identical to SEQ ID NO: 10626

SEQ ID NO: 31991 - DNA, 203 bp, Homo sapiens; identical to SEQ ID NO: 10627

SEQ ID NO: 31992 - DNA, 203 bp, Homo sapiens; identical to SEQ ID NO: 10647

SEQ ID NO: 31993 - DNA, 203 bp, Homo sapiens; identical to SEQ ID NO: 10649

SEQ ID NO: 31994 - DNA, 203 bp, Homo sapiens; identical to SEQ ID NO: 10650

SEQ ID NO: 31995 - DNA, 203 bp, Homo sapiens; identical to SEQ ID NO: 10651

SEQ ID NO: 31996 - DNA, 203 bp, Homo sapiens; identical to SEQ ID NO: 10665

SEQ ID NO: 31997 - DNA, 203 bp, Homo sapiens; identical to SEQ ID NO: 10666

SEQ ID NO: 31998 - DNA, 203 bp, Homo sapiens; identical to SEQ ID NO: 10668

SEQ ID NO: 31999 - DNA, 203 bp, Homo sapiens; identical to SEQ ID NO: 10672

SEQ ID NO: 32000 - DNA, 203 bp, Homo sapiens; identical to SEQ ID NO: 10673

SEQ ID NO: 32001 - DNA, 203 bp, Homo sapiens; identical to SEQ ID NO: 10678

SEQ ID NO: 32002 - DNA, 203 bp, Homo sapiens; identical to SEQ ID NO: 10691

SEQ ID NO: 32003 - DNA, 203 bp, Homo sapiens; identical to SEQ ID NO: 10692

SEQ ID NO: 32004 - DNA, 203 bp, Homo sapiens; identical to SEQ ID NO: 10697

SEQ ID NO: 32005 - DNA, 203 bp, Homo sapiens; identical to SEQ ID NO: 10723

SEQ ID NO: 32006 - DNA, 203 bp, Homo sapiens; identical to SEQ ID NO: 10725

SEQ ID NO: 32007 - DNA, 203 bp, Homo sapiens; identical to SEQ ID NO: 10727

SEQ ID NO: 32008 - DNA, 203 bp, Homo sapiens; identical to SEQ ID NO: 10733

SEQ ID NO: 32009 - DNA, 203 bp, Homo sapiens; identical to SEQ ID NO: 10751

SEQ ID NO: 32010 - DNA, 203 bp, Homo sapiens; identical to SEQ ID NO: 10752

SEQ ID NO: 32011 - DNA, 203 bp, Homo sapiens; identical to SEQ ID NO: 10766

SEQ ID NO: 32012 - DNA, 203 bp, Homo sapiens; identical to SEQ ID NO: 10767

SEQ ID NO: 32013 - DNA, 203 bp, Homo sapiens; identical to SEQ ID NO: 10768

SEQ ID NO: 32014 - DNA, 203 bp, Homo sapiens; identical to SEQ ID NO: 10769

SEQ ID NO: 32015 - DNA, 203 bp, Homo sapiens; identical to SEQ ID NO: 10771

SEQ ID NO: 32016 - DNA, 203 bp, Homo sapiens; identical to SEQ ID NO: 10772

SEQ ID NO: 32017 - DNA, 203 bp, Homo sapiens; identical to SEQ ID NO: 10773

SEQ ID NO: 32018 - DNA, 203 bp, Homo sapiens; identical to SEQ ID NO: 10774

SEQ ID NO: 32019 - DNA, 203 bp, Homo sapiens; identical to SEQ ID NO: 10786

SEQ ID NO: 32020 - DNA, 203 bp, Homo sapiens; identical to SEQ ID NO: 10789

SEQ ID NO: 32021 - DNA, 203 bp, Homo sapiens; identical to SEQ ID NO: 10792

SEQ ID NO: 32022 - DNA, 203 bp, Homo sapiens; identical to SEQ ID NO: 10801

SEQ ID NO: 32023 - DNA, 203 bp, Homo sapiens; identical to SEQ ID NO: 10802

SEQ ID NO: 32024 - DNA, 203 bp, Homo sapiens; identical to SEQ ID NO: 10803

SEQ ID NO: 32025 - DNA, 203 bp, Homo sapiens; identical to SEQ ID NO: 10815

SEQ ID NO: 32026 - DNA, 203 bp, Homo sapiens; identical to SEQ ID NO: 10856

SEQ ID NO: 32027 - DNA, 203 bp, Homo sapiens; identical to SEQ ID NO: 10860

SEQ ID NO: 32028 - DNA, 203 bp, Homo sapiens; identical to SEQ ID NO: 10861

SEQ ID NO: 32029 - DNA, 203 bp, Homo sapiens; identical to SEQ ID NO: 10863

SEQ ID NO: 32030 - DNA, 203 bp, Homo sapiens; identical to SEQ ID NO: 10864

SEQ ID NO: 32031 - DNA, 203 bp, Homo sapiens; identical to SEQ ID NO: 10865

SEQ ID NO: 32032 - DNA, 203 bp, Homo sapiens; identical to SEQ ID NO: 10870

SEQ ID NO: 32033 - DNA, 203 bp, Homo sapiens; identical to SEQ ID NO: 10871

SEQ ID NO: 32034 - DNA, 203 bp, Homo sapiens; identical to SEQ ID NO: 10873

SEQ ID NO: 32035 - DNA, 203 bp, Homo sapiens; identical to SEQ ID NO: 10903

SEQ ID NO: 32036 - DNA, 203 bp, Homo sapiens; identical to SEQ ID NO: 10929

SEQ ID NO: 32037 - DNA, 203 bp, Homo sapiens; identical to SEQ ID NO: 10930

SEQ ID NO: 32038 - DNA, 203 bp, Homo sapiens; identical to SEQ ID NO: 10931

SEQ ID NO: 32039 - DNA, 203 bp, Homo sapiens; identical to SEQ ID NO: 10932

SEQ ID NO: 32040 - DNA, 203 bp, Homo sapiens; identical to SEQ ID NO: 10933

SEQ ID NO: 32041 - DNA, 203 bp, Homo sapiens; identical to SEQ ID NO: 10935

SEQ ID NO: 32042 - DNA, 203 bp, Homo sapiens; identical to SEQ ID NO: 10944

SEQ ID NO: 32043 - DNA, 203 bp, Homo sapiens; identical to SEQ ID NO: 10948

SEQ ID NO: 32044 - DNA, 203 bp, Homo sapiens; identical to SEQ ID NO: 10950

SEQ ID NO: 32045 - DNA, 203 bp, Homo sapiens; identical to SEQ ID NO: 10953

SEQ ID NO: 32046 - DNA, 203 bp, Homo sapiens; identical to SEQ ID NO: 10955

SEQ ID NO: 32047 - DNA, 203 bp, Homo sapiens; identical to SEQ ID NO: 10959

SEQ ID NO: 32048 - DNA, 203 bp, Homo sapiens; identical to SEQ ID NO: 10960

SEQ ID NO: 32049 - DNA, 203 bp, Homo sapiens; identical to SEQ ID NO: 10961

SEQ ID NO: 32050 - DNA, 203 bp, Homo sapiens; identical to SEQ ID NO: 10962

SEQ ID NO: 32051 - DNA, 203 bp, Homo sapiens; identical to SEQ ID NO: 10963

SEQ ID NO: 32052 - DNA, 203 bp, Homo sapiens; identical to SEQ ID NO: 10964

SEQ ID NO: 32053 - DNA, 203 bp, Homo sapiens; identical to SEQ ID NO: 10965

SEQ ID NO: 32054 - DNA, 203 bp, Homo sapiens; identical to SEQ ID NO: 10973

SEQ ID NO: 32055 - DNA, 203 bp, Homo sapiens; identical to SEQ ID NO: 10978

SEQ ID NO: 32056 - DNA, 203 bp, Homo sapiens; identical to SEQ ID NO: 11013

SEQ ID NO: 32057 - DNA, 203 bp, Homo sapiens; identical to SEQ ID NO: 11018

SEQ ID NO: 32058 - DNA, 203 bp, Homo sapiens; identical to SEQ ID NO: 11025

SEQ ID NO: 32059 - DNA, 203 bp, Homo sapiens; identical to SEQ ID NO: 11026

SEQ ID NO: 32060 - DNA, 203 bp, Homo sapiens; identical to SEQ ID NO: 11030

SEQ ID NO: 32061 - DNA, 203 bp, Homo sapiens; identical to SEQ ID NO: 11041

SEQ ID NO: 32062 - DNA, 203 bp, Homo sapiens; identical to SEQ ID NO: 11042

SEQ ID NO: 32063 - DNA, 203 bp, Homo sapiens; identical to SEQ ID NO: 11043

SEQ ID NO: 32064 - DNA, 203 bp, Homo sapiens; identical to SEQ ID NO: 11045

SEQ ID NO: 32065 - DNA, 203 bp, Homo sapiens; identical to SEQ ID NO: 11047

SEQ ID NO: 32066 - DNA, 203 bp, Homo sapiens; identical to SEQ ID NO: 11067

SEQ ID NO: 32067 - DNA, 203 bp, Homo sapiens; identical to SEQ ID NO: 11068

SEQ ID NO: 32068 - DNA, 203 bp, Homo sapiens; identical to SEQ ID NO: 11069

SEQ ID NO: 32069 - DNA, 203 bp, Homo sapiens; identical to SEQ ID NO: 11081

SEQ ID NO: 32070 - DNA, 203 bp, Homo sapiens; identical to SEQ ID NO: 11082

SEQ ID NO: 32071 - DNA, 203 bp, Homo sapiens; identical to SEQ ID NO: 11084

SEQ ID NO: 32072 - DNA, 203 bp, Homo sapiens; identical to SEQ ID NO: 11085

SEQ ID NO: 32073 - DNA, 203 bp, Homo sapiens; identical to SEQ ID NO: 11104

SEQ ID NO: 32074 - DNA, 203 bp, Homo sapiens; identical to SEQ ID NO: 11105

SEQ ID NO: 32075 - DNA, 203 bp, Homo sapiens; identical to SEQ ID NO: 11106

SEQ ID NO: 32076 - DNA, 203 bp, Homo sapiens; identical to SEQ ID NO: 11112

SEQ ID NO: 32077 - DNA, 203 bp, Homo sapiens; identical to SEQ ID NO: 11120

SEQ ID NO: 32078 - DNA, 203 bp, Homo sapiens; identical to SEQ ID NO: 11121

SEQ ID NO: 32079 - DNA, 203 bp, Homo sapiens; identical to SEQ ID NO: 11122

SEQ ID NO: 32080 - DNA, 203 bp, Homo sapiens; identical to SEQ ID NO: 11123

SEQ ID NO: 32081 - DNA, 203 bp, Homo sapiens; identical to SEQ ID NO: 11125

SEQ ID NO: 32082 - DNA, 203 bp, Homo sapiens; identical to SEQ ID NO: 11134

SEQ ID NO: 32083 - DNA, 203 bp, Homo sapiens; identical to SEQ ID NO: 11178

SEQ ID NO: 32084 - DNA, 203 bp, Homo sapiens; identical to SEQ ID NO: 11179

SEQ ID NO: 32085 - DNA, 203 bp, Homo sapiens; identical to SEQ ID NO: 11181

SEQ ID NO: 32086 - DNA, 203 bp, Homo sapiens; identical to SEQ ID NO: 11200

SEQ ID NO: 32087 - DNA, 203 bp, Homo sapiens; identical to SEQ ID NO: 11212

SEQ ID NO: 32088 - DNA, 203 bp, Homo sapiens; identical to SEQ ID NO: 11244

SEQ ID NO: 32089 - DNA, 203 bp, Homo sapiens; identical to SEQ ID NO: 11282

SEQ ID NO: 32090 - DNA, 203 bp, Homo sapiens; identical to SEQ ID NO: 11283

SEQ ID NO: 32091 - DNA, 203 bp, Homo sapiens; identical to SEQ ID NO: 11292

SEQ ID NO: 32092 - DNA, 203 bp, Homo sapiens; identical to SEQ ID NO: 11293

SEQ ID NO: 32093 - DNA, 203 bp, Homo sapiens; identical to SEQ ID NO: 11313

SEQ ID NO: 32094 - DNA, 203 bp, Homo sapiens; identical to SEQ ID NO: 11314

SEQ ID NO: 32095 - DNA, 203 bp, Homo sapiens; identical to SEQ ID NO: 11317

SEQ ID NO: 32096 - DNA, 203 bp, Homo sapiens; identical to SEQ ID NO: 11318

SEQ ID NO: 32097 - DNA, 203 bp, Homo sapiens; identical to SEQ ID NO: 11342

SEQ ID NO: 32098 - DNA, 203 bp, Homo sapiens; identical to SEQ ID NO: 11343

SEQ ID NO: 32099 - DNA, 203 bp, Homo sapiens; identical to SEQ ID NO: 11344

SEQ ID NO: 32100 - DNA, 203 bp, Homo sapiens; identical to SEQ ID NO: 11345

SEQ ID NO: 32101 - DNA, 203 bp, Homo sapiens; identical to SEQ ID NO: 11346

SEQ ID NO: 32102 - DNA, 203 bp, Homo sapiens; identical to SEQ ID NO: 11347

SEQ ID NO: 32103 - DNA, 203 bp, Homo sapiens; identical to SEQ ID NO: 11348

SEQ ID NO: 32104 - DNA, 203 bp, Homo sapiens; identical to SEQ ID NO: 11349

SEQ ID NO: 32105 - DNA, 203 bp, Homo sapiens; identical to SEQ ID NO: 11350

SEQ ID NO: 32106 - DNA, 203 bp, Homo sapiens; identical to SEQ ID NO: 11351

SEQ ID NO: 32107 - DNA, 203 bp, Homo sapiens; identical to SEQ ID NO: 11352

SEQ ID NO: 32108 - DNA, 203 bp, Homo sapiens; identical to SEQ ID NO: 11353

SEQ ID NO: 32109 - DNA, 203 bp, Homo sapiens; identical to SEQ ID NO: 11354

SEQ ID NO: 32110 - DNA, 203 bp, Homo sapiens; identical to SEQ ID NO: 11355

SEQ ID NO: 32111 - DNA, 203 bp, Homo sapiens; identical to SEQ ID NO: 11357

SEQ ID NO: 32112 - DNA, 203 bp, Homo sapiens; identical to SEQ ID NO: 11359

SEQ ID NO: 32113 - DNA, 203 bp, Homo sapiens; identical to SEQ ID NO: 11360

SEQ ID NO: 32114 - DNA, 203 bp, Homo sapiens; identical to SEQ ID NO: 11361

SEQ ID NO: 32115 - DNA, 203 bp, Homo sapiens; identical to SEQ ID NO: 11363

SEQ ID NO: 32116 - DNA, 203 bp, Homo sapiens; identical to SEQ ID NO: 11364

SEQ ID NO: 32117 - DNA, 203 bp, Homo sapiens; identical to SEQ ID NO: 11365

SEQ ID NO: 32118 - DNA, 203 bp, Homo sapiens; identical to SEQ ID NO: 11367

SEQ ID NO: 32119 - DNA, 203 bp, Homo sapiens; identical to SEQ ID NO: 11368

SEQ ID NO: 32120 - DNA, 203 bp, Homo sapiens; identical to SEQ ID NO: 11369

SEQ ID NO: 32121 - DNA, 203 bp, Homo sapiens; identical to SEQ ID NO: 11370

SEQ ID NO: 32122 - DNA, 203 bp, Homo sapiens; identical to SEQ ID NO: 11385

SEQ ID NO: 32123 - DNA, 203 bp, Homo sapiens; identical to SEQ ID NO: 11386

SEQ ID NO: 32124 - DNA, 203 bp, Homo sapiens; identical to SEQ ID NO: 11387

SEQ ID NO: 32125 - DNA, 203 bp, Homo sapiens; identical to SEQ ID NO: 11388

SEQ ID NO: 32126 - DNA, 203 bp, Homo sapiens; identical to SEQ ID NO: 11389

SEQ ID NO: 32127 - DNA, 203 bp, Homo sapiens; identical to SEQ ID NO: 11395

SEQ ID NO: 32128 - DNA, 203 bp, Homo sapiens; identical to SEQ ID NO: 11396

SEQ ID NO: 32129 - DNA, 203 bp, Homo sapiens; identical to SEQ ID NO: 11397

SEQ ID NO: 32130 - DNA, 203 bp, Homo sapiens; identical to SEQ ID NO: 11398

SEQ ID NO: 32131 - DNA, 203 bp, Homo sapiens; identical to SEQ ID NO: 11404

SEQ ID NO: 32132 - DNA, 203 bp, Homo sapiens; identical to SEQ ID NO: 11405

SEQ ID NO: 32133 - DNA, 203 bp, Homo sapiens; identical to SEQ ID NO: 11411

SEQ ID NO: 32134 - DNA, 203 bp, Homo sapiens; identical to SEQ ID NO: 11412

SEQ ID NO: 32135 - DNA, 203 bp, Homo sapiens; identical to SEQ ID NO: 11413

SEQ ID NO: 32136 - DNA, 203 bp, Homo sapiens; identical to SEQ ID NO: 11439

SEQ ID NO: 32137 - DNA, 203 bp, Homo sapiens; identical to SEQ ID NO: 11451

SEQ ID NO: 32138 - DNA, 203 bp, Homo sapiens; identical to SEQ ID NO: 11461

SEQ ID NO: 32139 - DNA, 203 bp, Homo sapiens; identical to SEQ ID NO: 11462

SEQ ID NO: 32140 - DNA, 203 bp, Homo sapiens; identical to SEQ ID NO: 11466

SEQ ID NO: 32141 - DNA, 203 bp, Homo sapiens; identical to SEQ ID NO: 11481

SEQ ID NO: 32142 - DNA, 203 bp, Homo sapiens; identical to SEQ ID NO: 11483

SEQ ID NO: 32143 - DNA, 203 bp, Homo sapiens; identical to SEQ ID NO: 11504

SEQ ID NO: 32144 - DNA, 203 bp, Homo sapiens; identical to SEQ ID NO: 11505

SEQ ID NO: 32145 - DNA, 203 bp, Homo sapiens; identical to SEQ ID NO: 11517

SEQ ID NO: 32146 - DNA, 203 bp, Homo sapiens; identical to SEQ ID NO: 11518

SEQ ID NO: 32147 - DNA, 203 bp, Homo sapiens; identical to SEQ ID NO: 11519

SEQ ID NO: 32148 - DNA, 203 bp, Homo sapiens; identical to SEQ ID NO: 11521

SEQ ID NO: 32149 - DNA, 203 bp, Homo sapiens; identical to SEQ ID NO: 11522

SEQ ID NO: 32150 - DNA, 203 bp, Homo sapiens; identical to SEQ ID NO: 11523

SEQ ID NO: 32151 - DNA, 203 bp, Homo sapiens; identical to SEQ ID NO: 11545

SEQ ID NO: 32152 - DNA, 203 bp, Homo sapiens; identical to SEQ ID NO: 11546

SEQ ID NO: 32153 - DNA, 203 bp, Homo sapiens; identical to SEQ ID NO: 11547

SEQ ID NO: 32154 - DNA, 203 bp, Homo sapiens; identical to SEQ ID NO: 11548

SEQ ID NO: 32155 - DNA, 203 bp, Homo sapiens; identical to SEQ ID NO: 11559

SEQ ID NO: 32156 - DNA, 203 bp, Homo sapiens; identical to SEQ ID NO: 11565

SEQ ID NO: 32157 - DNA, 203 bp, Homo sapiens; identical to SEQ ID NO: 11566

SEQ ID NO: 32158 - DNA, 203 bp, Homo sapiens; identical to SEQ ID NO: 11569

SEQ ID NO: 32159 - DNA, 203 bp, Homo sapiens; identical to SEQ ID NO: 11570

SEQ ID NO: 32160 - DNA, 203 bp, Homo sapiens; identical to SEQ ID NO: 11571

SEQ ID NO: 32161 - DNA, 203 bp, Homo sapiens; identical to SEQ ID NO: 11572

SEQ ID NO: 32162 - DNA, 203 bp, Homo sapiens; identical to SEQ ID NO: 11581

SEQ ID NO: 32163 - DNA, 203 bp, Homo sapiens; identical to SEQ ID NO: 11582

SEQ ID NO: 32164 - DNA, 203 bp, Homo sapiens; identical to SEQ ID NO: 11594

SEQ ID NO: 32165 - DNA, 203 bp, Homo sapiens; identical to SEQ ID NO: 11596

SEQ ID NO: 32166 - DNA, 203 bp, Homo sapiens; identical to SEQ ID NO: 11597

SEQ ID NO: 32167 - DNA, 203 bp, Homo sapiens; identical to SEQ ID NO: 11601

SEQ ID NO: 32168 - DNA, 203 bp, Homo sapiens; identical to SEQ ID NO: 11602

SEQ ID NO: 32169 - DNA, 203 bp, Homo sapiens; identical to SEQ ID NO: 11603

SEQ ID NO: 32170 - DNA, 203 bp, Homo sapiens; identical to SEQ ID NO: 11604

SEQ ID NO: 32171 - DNA, 203 bp, Homo sapiens; identical to SEQ ID NO: 11605

SEQ ID NO: 32172 - DNA, 203 bp, Homo sapiens; identical to SEQ ID NO: 11606

SEQ ID NO: 32173 - DNA, 203 bp, Homo sapiens; identical to SEQ ID NO: 11609

SEQ ID NO: 32174 - DNA, 203 bp, Homo sapiens; identical to SEQ ID NO: 11630

SEQ ID NO: 32175 - DNA, 203 bp, Homo sapiens; identical to SEQ ID NO: 11656

SEQ ID NO: 32176 - DNA, 203 bp, Homo sapiens; identical to SEQ ID NO: 11661

SEQ ID NO: 32177 - DNA, 203 bp, Homo sapiens; identical to SEQ ID NO: 11662

SEQ ID NO: 32178 - DNA, 203 bp, Homo sapiens; identical to SEQ ID NO: 11663

SEQ ID NO: 32179 - DNA, 203 bp, Homo sapiens; identical to SEQ ID NO: 11696

SEQ ID NO: 32180 - DNA, 203 bp, Homo sapiens; identical to SEQ ID NO: 11706

SEQ ID NO: 32181 - DNA, 203 bp, Homo sapiens; identical to SEQ ID NO: 11707

SEQ ID NO: 32182 - DNA, 203 bp, Homo sapiens; identical to SEQ ID NO: 11708

SEQ ID NO: 32183 - DNA, 203 bp, Homo sapiens; identical to SEQ ID NO: 11709

SEQ ID NO: 32184 - DNA, 203 bp, Homo sapiens; identical to SEQ ID NO: 11711

SEQ ID NO: 32185 - DNA, 203 bp, Homo sapiens; identical to SEQ ID NO: 11712

SEQ ID NO: 32186 - DNA, 203 bp, Homo sapiens; identical to SEQ ID NO: 11719

SEQ ID NO: 32187 - DNA, 203 bp, Homo sapiens; identical to SEQ ID NO: 11727

SEQ ID NO: 32188 - DNA, 203 bp, Homo sapiens; identical to SEQ ID NO: 11731

SEQ ID NO: 32189 - DNA, 203 bp, Homo sapiens; identical to SEQ ID NO: 11751

SEQ ID NO: 32190 - DNA, 203 bp, Homo sapiens; identical to SEQ ID NO: 11765

SEQ ID NO: 32191 - DNA, 203 bp, Homo sapiens; identical to SEQ ID NO: 11767

SEQ ID NO: 32192 - DNA, 203 bp, Homo sapiens; identical to SEQ ID NO: 11768

SEQ ID NO: 32193 - DNA, 203 bp, Homo sapiens; identical to SEQ ID NO: 11769

SEQ ID NO: 32194 - DNA, 203 bp, Homo sapiens; identical to SEQ ID NO: 11772

SEQ ID NO: 32195 - DNA, 203 bp, Homo sapiens; identical to SEQ ID NO: 11773

SEQ ID NO: 32196 - DNA, 203 bp, Homo sapiens; identical to SEQ ID NO: 11774

SEQ ID NO: 32197 - DNA, 203 bp, Homo sapiens; identical to SEQ ID NO: 11782

SEQ ID NO: 32198 - DNA, 203 bp, Homo sapiens; identical to SEQ ID NO: 11791

SEQ ID NO: 32199 - DNA, 203 bp, Homo sapiens; identical to SEQ ID NO: 11812

SEQ ID NO: 32200 - DNA, 203 bp, Homo sapiens; identical to SEQ ID NO: 11813

SEQ ID NO: 32201 - DNA, 203 bp, Homo sapiens; identical to SEQ ID NO: 11814

SEQ ID NO: 32202 - DNA, 203 bp, Homo sapiens; identical to SEQ ID NO: 11815

SEQ ID NO: 32203 - DNA, 203 bp, Homo sapiens; identical to SEQ ID NO: 11816

SEQ ID NO: 32204 - DNA, 203 bp, Homo sapiens; identical to SEQ ID NO: 11817

SEQ ID NO: 32205 - DNA, 203 bp, Homo sapiens; identical to SEQ ID NO: 11831

SEQ ID NO: 32206 - DNA, 203 bp, Homo sapiens; identical to SEQ ID NO: 11838

SEQ ID NO: 32207 - DNA, 203 bp, Homo sapiens; identical to SEQ ID NO: 11839

SEQ ID NO: 32208 - DNA, 203 bp, Homo sapiens; identical to SEQ ID NO: 11841

SEQ ID NO: 32209 - DNA, 203 bp, Homo sapiens; identical to SEQ ID NO: 11842

SEQ ID NO: 32210 - DNA, 203 bp, Homo sapiens; identical to SEQ ID NO: 11863

SEQ ID NO: 32211 - DNA, 203 bp, Homo sapiens; identical to SEQ ID NO: 11866

SEQ ID NO: 32212 - DNA, 203 bp, Homo sapiens; identical to SEQ ID NO: 11867

SEQ ID NO: 32213 - DNA, 203 bp, Homo sapiens; identical to SEQ ID NO: 11868

SEQ ID NO: 32214 - DNA, 203 bp, Homo sapiens; identical to SEQ ID NO: 11869

SEQ ID NO: 32215 - DNA, 203 bp, Homo sapiens; identical to SEQ ID NO: 11870

SEQ ID NO: 32216 - DNA, 203 bp, Homo sapiens; identical to SEQ ID NO: 11871

SEQ ID NO: 32217 - DNA, 203 bp, Homo sapiens; identical to SEQ ID NO: 11885

SEQ ID NO: 32218 - DNA, 203 bp, Homo sapiens; identical to SEQ ID NO: 11886

SEQ ID NO: 32219 - DNA, 203 bp, Homo sapiens; identical to SEQ ID NO: 11887

SEQ ID NO: 32220 - DNA, 203 bp, Homo sapiens; identical to SEQ ID NO: 11889

SEQ ID NO: 32221 - DNA, 203 bp, Homo sapiens; identical to SEQ ID NO: 11891

SEQ ID NO: 32222 - DNA, 203 bp, Homo sapiens; identical to SEQ ID NO: 11902

SEQ ID NO: 32223 - DNA, 203 bp, Homo sapiens; identical to SEQ ID NO: 11904

SEQ ID NO: 32224 - DNA, 203 bp, Homo sapiens; identical to SEQ ID NO: 11905

SEQ ID NO: 32225 - DNA, 203 bp, Homo sapiens; identical to SEQ ID NO: 11906

SEQ ID NO: 32226 - DNA, 203 bp, Homo sapiens; identical to SEQ ID NO: 11907

SEQ ID NO: 32227 - DNA, 203 bp, Homo sapiens; identical to SEQ ID NO: 11909

SEQ ID NO: 32228 - DNA, 203 bp, Homo sapiens; identical to SEQ ID NO: 11910

SEQ ID NO: 32229 - DNA, 203 bp, Homo sapiens; identical to SEQ ID NO: 11911

SEQ ID NO: 32230 - DNA, 203 bp, Homo sapiens; identical to SEQ ID NO: 11912

SEQ ID NO: 32231 - DNA, 203 bp, Homo sapiens; identical to SEQ ID NO: 11914

SEQ ID NO: 32232 - DNA, 203 bp, Homo sapiens; identical to SEQ ID NO: 11921

SEQ ID NO: 32233 - DNA, 203 bp, Homo sapiens; identical to SEQ ID NO: 11922

SEQ ID NO: 32234 - DNA, 203 bp, Homo sapiens; identical to SEQ ID NO: 11923

SEQ ID NO: 32235 - DNA, 203 bp, Homo sapiens; identical to SEQ ID NO: 11925

SEQ ID NO: 32236 - DNA, 203 bp, Homo sapiens; identical to SEQ ID NO: 11926

SEQ ID NO: 32237 - DNA, 203 bp, Homo sapiens; identical to SEQ ID NO: 11927

SEQ ID NO: 32238 - DNA, 203 bp, Homo sapiens; identical to SEQ ID NO: 11956

SEQ ID NO: 32239 - DNA, 203 bp, Homo sapiens; identical to SEQ ID NO: 11957

SEQ ID NO: 32240 - DNA, 203 bp, Homo sapiens; identical to SEQ ID NO: 11958

SEQ ID NO: 32241 - DNA, 203 bp, Homo sapiens; identical to SEQ ID NO: 11964

SEQ ID NO: 32242 - DNA, 203 bp, Homo sapiens; identical to SEQ ID NO: 11992

SEQ ID NO: 32243 - DNA, 203 bp, Homo sapiens; identical to SEQ ID NO: 11994

SEQ ID NO: 32244 - DNA, 203 bp, Homo sapiens; identical to SEQ ID NO: 11995

SEQ ID NO: 32245 - DNA, 203 bp, Homo sapiens; identical to SEQ ID NO: 11996

SEQ ID NO: 32246 - DNA, 203 bp, Homo sapiens; identical to SEQ ID NO: 11997

SEQ ID NO: 32247 - DNA, 203 bp, Homo sapiens; identical to SEQ ID NO: 11998

SEQ ID NO: 32248 - DNA, 203 bp, Homo sapiens; identical to SEQ ID NO: 12000

SEQ ID NO: 32249 - DNA, 203 bp, Homo sapiens; identical to SEQ ID NO: 12001

SEQ ID NO: 32250 - DNA, 203 bp, Homo sapiens; identical to SEQ ID NO: 12012

SEQ ID NO: 32251 - DNA, 203 bp, Homo sapiens; identical to SEQ ID NO: 12018

SEQ ID NO: 32252 - DNA, 203 bp, Homo sapiens; identical to SEQ ID NO: 12021

SEQ ID NO: 32253 - DNA, 203 bp, Homo sapiens; identical to SEQ ID NO: 12022

SEQ ID NO: 32254 - DNA, 203 bp, Homo sapiens; identical to SEQ ID NO: 12023

SEQ ID NO: 32255 - DNA, 203 bp, Homo sapiens; identical to SEQ ID NO: 12024

SEQ ID NO: 32256 - DNA, 203 bp, Homo sapiens; identical to SEQ ID NO: 12025

SEQ ID NO: 32257 - DNA, 203 bp, Homo sapiens; identical to SEQ ID NO: 12044

SEQ ID NO: 32258 - DNA, 203 bp, Homo sapiens; identical to SEQ ID NO: 12067

SEQ ID NO: 32259 - DNA, 203 bp, Homo sapiens; identical to SEQ ID NO: 12069

SEQ ID NO: 32260 - DNA, 203 bp, Homo sapiens; identical to SEQ ID NO: 12070

SEQ ID NO: 32261 - DNA, 203 bp, Homo sapiens; identical to SEQ ID NO: 12071

SEQ ID NO: 32262 - DNA, 203 bp, Homo sapiens; identical to SEQ ID NO: 12078

SEQ ID NO: 32263 - DNA, 203 bp, Homo sapiens; identical to SEQ ID NO: 12079

SEQ ID NO: 32264 - DNA, 203 bp, Homo sapiens; identical to SEQ ID NO: 12081

SEQ ID NO: 32265 - DNA, 203 bp, Homo sapiens; identical to SEQ ID NO: 12082

SEQ ID NO: 32266 - DNA, 203 bp, Homo sapiens; identical to SEQ ID NO: 12088

SEQ ID NO: 32267 - DNA, 203 bp, Homo sapiens; identical to SEQ ID NO: 12089

SEQ ID NO: 32268 - DNA, 203 bp, Homo sapiens; identical to SEQ ID NO: 12091

SEQ ID NO: 32269 - DNA, 203 bp, Homo sapiens; identical to SEQ ID NO: 12097

SEQ ID NO: 32270 - DNA, 203 bp, Homo sapiens; identical to SEQ ID NO: 12099

SEQ ID NO: 32271 - DNA, 203 bp, Homo sapiens; identical to SEQ ID NO: 12154

SEQ ID NO: 32272 - DNA, 203 bp, Homo sapiens; identical to SEQ ID NO: 12181

SEQ ID NO: 32273 - DNA, 203 bp, Homo sapiens; identical to SEQ ID NO: 12183

SEQ ID NO: 32274 - DNA, 203 bp, Homo sapiens; identical to SEQ ID NO: 12184

SEQ ID NO: 32275 - DNA, 203 bp, Homo sapiens; identical to SEQ ID NO: 12185

SEQ ID NO: 32276 - DNA, 203 bp, Homo sapiens; identical to SEQ ID NO: 12186

SEQ ID NO: 32277 - DNA, 203 bp, Homo sapiens; identical to SEQ ID NO: 12196

SEQ ID NO: 32278 - DNA, 203 bp, Homo sapiens; identical to SEQ ID NO: 12197

SEQ ID NO: 32279 - DNA, 203 bp, Homo sapiens; identical to SEQ ID NO: 12207

SEQ ID NO: 32280 - DNA, 203 bp, Homo sapiens; identical to SEQ ID NO: 12210

SEQ ID NO: 32281 - DNA, 203 bp, Homo sapiens; identical to SEQ ID NO: 12211

SEQ ID NO: 32282 - DNA, 203 bp, Homo sapiens; identical to SEQ ID NO: 12212

SEQ ID NO: 32283 - DNA, 203 bp, Homo sapiens; identical to SEQ ID NO: 12213

SEQ ID NO: 32284 - DNA, 203 bp, Homo sapiens; identical to SEQ ID NO: 12215

SEQ ID NO: 32285 - DNA, 203 bp, Homo sapiens; identical to SEQ ID NO: 12217

SEQ ID NO: 32286 - DNA, 203 bp, Homo sapiens; identical to SEQ ID NO: 12220

SEQ ID NO: 32287 - DNA, 203 bp, Homo sapiens; identical to SEQ ID NO: 12221

SEQ ID NO: 32288 - DNA, 203 bp, Homo sapiens; identical to SEQ ID NO: 12222

SEQ ID NO: 32289 - DNA, 203 bp, Homo sapiens; identical to SEQ ID NO: 12224

SEQ ID NO: 32290 - DNA, 203 bp, Homo sapiens; identical to SEQ ID NO: 12225

SEQ ID NO: 32291 - DNA, 203 bp, Homo sapiens; identical to SEQ ID NO: 12226

SEQ ID NO: 32292 - DNA, 203 bp, Homo sapiens; identical to SEQ ID NO: 12227

SEQ ID NO: 32293 - DNA, 203 bp, Homo sapiens; identical to SEQ ID NO: 12232

SEQ ID NO: 32294 - DNA, 203 bp, Homo sapiens; identical to SEQ ID NO: 12233

SEQ ID NO: 32295 - DNA, 203 bp, Homo sapiens; identical to SEQ ID NO: 12235

SEQ ID NO: 32296 - DNA, 203 bp, Homo sapiens; identical to SEQ ID NO: 12236

SEQ ID NO: 32297 - DNA, 203 bp, Homo sapiens; identical to SEQ ID NO: 12273

SEQ ID NO: 32298 - DNA, 203 bp, Homo sapiens; identical to SEQ ID NO: 12280

SEQ ID NO: 32299 - DNA, 203 bp, Homo sapiens; identical to SEQ ID NO: 12281

SEQ ID NO: 32300 - DNA, 203 bp, Homo sapiens; identical to SEQ ID NO: 12282

SEQ ID NO: 32301 - DNA, 203 bp, Homo sapiens; identical to SEQ ID NO: 12283

SEQ ID NO: 32302 - DNA, 203 bp, Homo sapiens; identical to SEQ ID NO: 12294

SEQ ID NO: 32303 - DNA, 203 bp, Homo sapiens; identical to SEQ ID NO: 12295

SEQ ID NO: 32304 - DNA, 203 bp, Homo sapiens; identical to SEQ ID NO: 12306

SEQ ID NO: 32305 - DNA, 203 bp, Homo sapiens; identical to SEQ ID NO: 12307

SEQ ID NO: 32306 - DNA, 203 bp, Homo sapiens; identical to SEQ ID NO: 12309

SEQ ID NO: 32307 - DNA, 203 bp, Homo sapiens; identical to SEQ ID NO: 12310

SEQ ID NO: 32308 - DNA, 203 bp, Homo sapiens; identical to SEQ ID NO: 12312

SEQ ID NO: 32309 - DNA, 203 bp, Homo sapiens; identical to SEQ ID NO: 12331

SEQ ID NO: 32310 - DNA, 203 bp, Homo sapiens; identical to SEQ ID NO: 12333

SEQ ID NO: 32311 - DNA, 203 bp, Homo sapiens; identical to SEQ ID NO: 12345

SEQ ID NO: 32312 - DNA, 203 bp, Homo sapiens; identical to SEQ ID NO: 12346

SEQ ID NO: 32313 - DNA, 203 bp, Homo sapiens; identical to SEQ ID NO: 12353

SEQ ID NO: 32314 - DNA, 203 bp, Homo sapiens; identical to SEQ ID NO: 12354

SEQ ID NO: 32315 - DNA, 203 bp, Homo sapiens; identical to SEQ ID NO: 12366

SEQ ID NO: 32316 - DNA, 203 bp, Homo sapiens; identical to SEQ ID NO: 12371

SEQ ID NO: 32317 - DNA, 203 bp, Homo sapiens; identical to SEQ ID NO: 12382

SEQ ID NO: 32318 - DNA, 203 bp, Homo sapiens; identical to SEQ ID NO: 12390

SEQ ID NO: 32319 - DNA, 203 bp, Homo sapiens; identical to SEQ ID NO: 12395

SEQ ID NO: 32320 - DNA, 203 bp, Homo sapiens; identical to SEQ ID NO: 12398

SEQ ID NO: 32321 - DNA, 203 bp, Homo sapiens; identical to SEQ ID NO: 12404

SEQ ID NO: 32322 - DNA, 203 bp, Homo sapiens; identical to SEQ ID NO: 12406

SEQ ID NO: 32323 - DNA, 203 bp, Homo sapiens; identical to SEQ ID NO: 12409

SEQ ID NO: 32324 - DNA, 203 bp, Homo sapiens; identical to SEQ ID NO: 12410

SEQ ID NO: 32325 - DNA, 203 bp, Homo sapiens; identical to SEQ ID NO: 12411

SEQ ID NO: 32326 - DNA, 203 bp, Homo sapiens; identical to SEQ ID NO: 12421

SEQ ID NO: 32327 - DNA, 203 bp, Homo sapiens; identical to SEQ ID NO: 12422

SEQ ID NO: 32328 - DNA, 203 bp, Homo sapiens; identical to SEQ ID NO: 12423

SEQ ID NO: 32329 - DNA, 203 bp, Homo sapiens; identical to SEQ ID NO: 12425

SEQ ID NO: 32330 - DNA, 203 bp, Homo sapiens; identical to SEQ ID NO: 12426

SEQ ID NO: 32331 - DNA, 203 bp, Homo sapiens; identical to SEQ ID NO: 12427

SEQ ID NO: 32332 - DNA, 203 bp, Homo sapiens; identical to SEQ ID NO: 12428

SEQ ID NO: 32333 - DNA, 203 bp, Homo sapiens; identical to SEQ ID NO: 12453

SEQ ID NO: 32334 - DNA, 203 bp, Homo sapiens; identical to SEQ ID NO: 12454

SEQ ID NO: 32335 - DNA, 203 bp, Homo sapiens; identical to SEQ ID NO: 12466

SEQ ID NO: 32336 - DNA, 203 bp, Homo sapiens; identical to SEQ ID NO: 12467

SEQ ID NO: 32337 - DNA, 203 bp, Homo sapiens; identical to SEQ ID NO: 12468

SEQ ID NO: 32338 - DNA, 203 bp, Homo sapiens; identical to SEQ ID NO: 12469

SEQ ID NO: 32339 - DNA, 203 bp, Homo sapiens; identical to SEQ ID NO: 12470

SEQ ID NO: 32340 - DNA, 203 bp, Homo sapiens; identical to SEQ ID NO: 12473

SEQ ID NO: 32341 - DNA, 203 bp, Homo sapiens; identical to SEQ ID NO: 12474

SEQ ID NO: 32342 - DNA, 203 bp, Homo sapiens; identical to SEQ ID NO: 12486

SEQ ID NO: 32343 - DNA, 203 bp, Homo sapiens; identical to SEQ ID NO: 12496

SEQ ID NO: 32344 - DNA, 203 bp, Homo sapiens; identical to SEQ ID NO: 12497

SEQ ID NO: 32345 - DNA, 203 bp, Homo sapiens; identical to SEQ ID NO: 12499

SEQ ID NO: 32346 - DNA, 203 bp, Homo sapiens; identical to SEQ ID NO: 12500

SEQ ID NO: 32347 - DNA, 203 bp, Homo sapiens; identical to SEQ ID NO: 12518

SEQ ID NO: 32348 - DNA, 203 bp, Homo sapiens; identical to SEQ ID NO: 12519

SEQ ID NO: 32349 - DNA, 203 bp, Homo sapiens; identical to SEQ ID NO: 12520

SEQ ID NO: 32350 - DNA, 203 bp, Homo sapiens; identical to SEQ ID NO: 12521

SEQ ID NO: 32351 - DNA, 203 bp, Homo sapiens; identical to SEQ ID NO: 12523

SEQ ID NO: 32352 - DNA, 203 bp, Homo sapiens; identical to SEQ ID NO: 12524

SEQ ID NO: 32353 - DNA, 203 bp, Homo sapiens; identical to SEQ ID NO: 12525

SEQ ID NO: 32354 - DNA, 203 bp, Homo sapiens; identical to SEQ ID NO: 12546

SEQ ID NO: 32355 - DNA, 203 bp, Homo sapiens; identical to SEQ ID NO: 12548

SEQ ID NO: 32356 - DNA, 203 bp, Homo sapiens; identical to SEQ ID NO: 12549

SEQ ID NO: 32357 - DNA, 203 bp, Homo sapiens; identical to SEQ ID NO: 12550

SEQ ID NO: 32358 - DNA, 203 bp, Homo sapiens; identical to SEQ ID NO: 12551

SEQ ID NO: 32359 - DNA, 203 bp, Homo sapiens; identical to SEQ ID NO: 12593

SEQ ID NO: 32360 - DNA, 203 bp, Homo sapiens; identical to SEQ ID NO: 12594

SEQ ID NO: 32361 - DNA, 203 bp, Homo sapiens; identical to SEQ ID NO: 12601

SEQ ID NO: 32362 - DNA, 203 bp, Homo sapiens; identical to SEQ ID NO: 12624

SEQ ID NO: 32363 - DNA, 203 bp, Homo sapiens; identical to SEQ ID NO: 12626

SEQ ID NO: 32364 - DNA, 203 bp, Homo sapiens; identical to SEQ ID NO: 12627

SEQ ID NO: 32365 - DNA, 203 bp, Homo sapiens; identical to SEQ ID NO: 12628

SEQ ID NO: 32366 - DNA, 203 bp, Homo sapiens; identical to SEQ ID NO: 12630

SEQ ID NO: 32367 - DNA, 203 bp, Homo sapiens; identical to SEQ ID NO: 12631

SEQ ID NO: 32368 - DNA, 203 bp, Homo sapiens; identical to SEQ ID NO: 12632

SEQ ID NO: 32369 - DNA, 203 bp, Homo sapiens; identical to SEQ ID NO: 12634

SEQ ID NO: 32370 - DNA, 203 bp, Homo sapiens; identical to SEQ ID NO: 12635

SEQ ID NO: 32371 - DNA, 203 bp, Homo sapiens; identical to SEQ ID NO: 12637

SEQ ID NO: 32372 - DNA, 203 bp, Homo sapiens; identical to SEQ ID NO: 12638

SEQ ID NO: 32373 - DNA, 203 bp, Homo sapiens; identical to SEQ ID NO: 12640

SEQ ID NO: 32374 - DNA, 203 bp, Homo sapiens; identical to SEQ ID NO: 12641

SEQ ID NO: 32375 - DNA, 203 bp, Homo sapiens; identical to SEQ ID NO: 12643

SEQ ID NO: 32376 - DNA, 203 bp, Homo sapiens; identical to SEQ ID NO: 12644

SEQ ID NO: 32377 - DNA, 203 bp, Homo sapiens; identical to SEQ ID NO: 12645

SEQ ID NO: 32378 - DNA, 203 bp, Homo sapiens; identical to SEQ ID NO: 12646

SEQ ID NO: 32379 - DNA, 203 bp, Homo sapiens; identical to SEQ ID NO: 12675

SEQ ID NO: 32380 - DNA, 203 bp, Homo sapiens; identical to SEQ ID NO: 12677

SEQ ID NO: 32381 - DNA, 203 bp, Homo sapiens; identical to SEQ ID NO: 12678

SEQ ID NO: 32382 - DNA, 203 bp, Homo sapiens; identical to SEQ ID NO: 12679

SEQ ID NO: 32383 - DNA, 203 bp, Homo sapiens; identical to SEQ ID NO: 12689

SEQ ID NO: 32384 - DNA, 203 bp, Homo sapiens; identical to SEQ ID NO: 12690

SEQ ID NO: 32385 - DNA, 203 bp, Homo sapiens; identical to SEQ ID NO: 12691

SEQ ID NO: 32386 - DNA, 203 bp, Homo sapiens; identical to SEQ ID NO: 12702

SEQ ID NO: 32387 - DNA, 203 bp, Homo sapiens; identical to SEQ ID NO: 12703

SEQ ID NO: 32388 - DNA, 203 bp, Homo sapiens; identical to SEQ ID NO: 12705

SEQ ID NO: 32389 - DNA, 203 bp, Homo sapiens; identical to SEQ ID NO: 12707

SEQ ID NO: 32390 - DNA, 203 bp, Homo sapiens; identical to SEQ ID NO: 12708

SEQ ID NO: 32391 - DNA, 203 bp, Homo sapiens; identical to SEQ ID NO: 12709

SEQ ID NO: 32392 - DNA, 203 bp, Homo sapiens; identical to SEQ ID NO: 12725

SEQ ID NO: 32393 - DNA, 203 bp, Homo sapiens; identical to SEQ ID NO: 12726

SEQ ID NO: 32394 - DNA, 203 bp, Homo sapiens; identical to SEQ ID NO: 12727

SEQ ID NO: 32395 - DNA, 203 bp, Homo sapiens; identical to SEQ ID NO: 12737

SEQ ID NO: 32396 - DNA, 203 bp, Homo sapiens; identical to SEQ ID NO: 12739

SEQ ID NO: 32397 - DNA, 203 bp, Homo sapiens; identical to SEQ ID NO: 12740

SEQ ID NO: 32398 - DNA, 203 bp, Homo sapiens; identical to SEQ ID NO: 12741

SEQ ID NO: 32399 - DNA, 203 bp, Homo sapiens; identical to SEQ ID NO: 12744

SEQ ID NO: 32400 - DNA, 203 bp, Homo sapiens; identical to SEQ ID NO: 12758

SEQ ID NO: 32401 - DNA, 203 bp, Homo sapiens; identical to SEQ ID NO: 12759

SEQ ID NO: 32402 - DNA, 203 bp, Homo sapiens; identical to SEQ ID NO: 12762

SEQ ID NO: 32403 - DNA, 203 bp, Homo sapiens; identical to SEQ ID NO: 12781

SEQ ID NO: 32404 - DNA, 203 bp, Homo sapiens; identical to SEQ ID NO: 12782

SEQ ID NO: 32405 - DNA, 203 bp, Homo sapiens; identical to SEQ ID NO: 12783

SEQ ID NO: 32406 - DNA, 203 bp, Homo sapiens; identical to SEQ ID NO: 12785

SEQ ID NO: 32407 - DNA, 203 bp, Homo sapiens; identical to SEQ ID NO: 12802

SEQ ID NO: 32408 - DNA, 203 bp, Homo sapiens; identical to SEQ ID NO: 12803

SEQ ID NO: 32409 - DNA, 203 bp, Homo sapiens; identical to SEQ ID NO: 12804

SEQ ID NO: 32410 - DNA, 203 bp, Homo sapiens; identical to SEQ ID NO: 12806

SEQ ID NO: 32411 - DNA, 203 bp, Homo sapiens; identical to SEQ ID NO: 12817

SEQ ID NO: 32412 - DNA, 203 bp, Homo sapiens; identical to SEQ ID NO: 12818

SEQ ID NO: 32413 - DNA, 203 bp, Homo sapiens; identical to SEQ ID NO: 12825

SEQ ID NO: 32414 - DNA, 203 bp, Homo sapiens; identical to SEQ ID NO: 12847

SEQ ID NO: 32415 - DNA, 203 bp, Homo sapiens; identical to SEQ ID NO: 12850

SEQ ID NO: 32416 - DNA, 203 bp, Homo sapiens; identical to SEQ ID NO: 12851

SEQ ID NO: 32417 - DNA, 203 bp, Homo sapiens; identical to SEQ ID NO: 12857

SEQ ID NO: 32418 - DNA, 203 bp, Homo sapiens; identical to SEQ ID NO: 12858

SEQ ID NO: 32419 - DNA, 203 bp, Homo sapiens; identical to SEQ ID NO: 12859

SEQ ID NO: 32420 - DNA, 203 bp, Homo sapiens; identical to SEQ ID NO: 12860

SEQ ID NO: 32421 - DNA, 203 bp, Homo sapiens; identical to SEQ ID NO: 12862

SEQ ID NO: 32422 - DNA, 203 bp, Homo sapiens; identical to SEQ ID NO: 12863

SEQ ID NO: 32423 - DNA, 203 bp, Homo sapiens; identical to SEQ ID NO: 12864

SEQ ID NO: 32424 - DNA, 203 bp, Homo sapiens; identical to SEQ ID NO: 12872

SEQ ID NO: 32425 - DNA, 203 bp, Homo sapiens; identical to SEQ ID NO: 12887

SEQ ID NO: 32426 - DNA, 203 bp, Homo sapiens; identical to SEQ ID NO: 12894

SEQ ID NO: 32427 - DNA, 203 bp, Homo sapiens; identical to SEQ ID NO: 12901

SEQ ID NO: 32428 - DNA, 203 bp, Homo sapiens; identical to SEQ ID NO: 12906

SEQ ID NO: 32429 - DNA, 203 bp, Homo sapiens; identical to SEQ ID NO: 12919

SEQ ID NO: 32430 - DNA, 203 bp, Homo sapiens; identical to SEQ ID NO: 12940

SEQ ID NO: 32431 - DNA, 203 bp, Homo sapiens; identical to SEQ ID NO: 12941

SEQ ID NO: 32432 - DNA, 203 bp, Homo sapiens; identical to SEQ ID NO: 12948

SEQ ID NO: 32433 - DNA, 203 bp, Homo sapiens; identical to SEQ ID NO: 12950

SEQ ID NO: 32434 - DNA, 203 bp, Homo sapiens; identical to SEQ ID NO: 12951

SEQ ID NO: 32435 - DNA, 203 bp, Homo sapiens; identical to SEQ ID NO: 12952

SEQ ID NO: 32436 - DNA, 203 bp, Homo sapiens; identical to SEQ ID NO: 12953

SEQ ID NO: 32437 - DNA, 203 bp, Homo sapiens; identical to SEQ ID NO: 12954

SEQ ID NO: 32438 - DNA, 203 bp, Homo sapiens; identical to SEQ ID NO: 12955

SEQ ID NO: 32439 - DNA, 203 bp, Homo sapiens; identical to SEQ ID NO: 12956

SEQ ID NO: 32440 - DNA, 203 bp, Homo sapiens; identical to SEQ ID NO: 12957

SEQ ID NO: 32441 - DNA, 203 bp, Homo sapiens; identical to SEQ ID NO: 12958

SEQ ID NO: 32442 - DNA, 203 bp, Homo sapiens; identical to SEQ ID NO: 12959

SEQ ID NO: 32443 - DNA, 203 bp, Homo sapiens; identical to SEQ ID NO: 12961

SEQ ID NO: 32444 - DNA, 203 bp, Homo sapiens; identical to SEQ ID NO: 12964

SEQ ID NO: 32445 - DNA, 203 bp, Homo sapiens; identical to SEQ ID NO: 12965

SEQ ID NO: 32446 - DNA, 203 bp, Homo sapiens; identical to SEQ ID NO: 12968

SEQ ID NO: 32447 - DNA, 203 bp, Homo sapiens; identical to SEQ ID NO: 12972

SEQ ID NO: 32448 - DNA, 203 bp, Homo sapiens; identical to SEQ ID NO: 12993

SEQ ID NO: 32449 - DNA, 203 bp, Homo sapiens; identical to SEQ ID NO: 12995

SEQ ID NO: 32450 - DNA, 203 bp, Homo sapiens; identical to SEQ ID NO: 12996

SEQ ID NO: 32451 - DNA, 203 bp, Homo sapiens; identical to SEQ ID NO: 12997

SEQ ID NO: 32452 - DNA, 203 bp, Homo sapiens; identical to SEQ ID NO: 13005

SEQ ID NO: 32453 - DNA, 203 bp, Homo sapiens; identical to SEQ ID NO: 13009

SEQ ID NO: 32454 - DNA, 203 bp, Homo sapiens; identical to SEQ ID NO: 13010

SEQ ID NO: 32455 - DNA, 203 bp, Homo sapiens; identical to SEQ ID NO: 13011

SEQ ID NO: 32456 - DNA, 203 bp, Homo sapiens; identical to SEQ ID NO: 13025

SEQ ID NO: 32457 - DNA, 203 bp, Homo sapiens; identical to SEQ ID NO: 13028

SEQ ID NO: 32458 - DNA, 203 bp, Homo sapiens; identical to SEQ ID NO: 13029

SEQ ID NO: 32459 - DNA, 203 bp, Homo sapiens; identical to SEQ ID NO: 13033

SEQ ID NO: 32460 - DNA, 203 bp, Homo sapiens; identical to SEQ ID NO: 13034

SEQ ID NO: 32461 - DNA, 203 bp, Homo sapiens; identical to SEQ ID NO: 13035

SEQ ID NO: 32462 - DNA, 203 bp, Homo sapiens; identical to SEQ ID NO: 13036

SEQ ID NO: 32463 - DNA, 203 bp, Homo sapiens; identical to SEQ ID NO: 13056

SEQ ID NO: 32464 - DNA, 203 bp, Homo sapiens; identical to SEQ ID NO: 13077

SEQ ID NO: 32465 - DNA, 203 bp, Homo sapiens; identical to SEQ ID NO: 13078

SEQ ID NO: 32466 - DNA, 203 bp, Homo sapiens; identical to SEQ ID NO: 13083

SEQ ID NO: 32467 - DNA, 203 bp, Homo sapiens; identical to SEQ ID NO: 13090

SEQ ID NO: 32468 - DNA, 203 bp, Homo sapiens; identical to SEQ ID NO: 13152

SEQ ID NO: 32469 - DNA, 203 bp, Homo sapiens; identical to SEQ ID NO: 13160

SEQ ID NO: 32470 - DNA, 203 bp, Homo sapiens; identical to SEQ ID NO: 13173

SEQ ID NO: 32471 - DNA, 203 bp, Homo sapiens; identical to SEQ ID NO: 13175

SEQ ID NO: 32472 - DNA, 203 bp, Homo sapiens; identical to SEQ ID NO: 13176

SEQ ID NO: 32473 - DNA, 203 bp, Homo sapiens; identical to SEQ ID NO: 13177

SEQ ID NO: 32474 - DNA, 203 bp, Homo sapiens; identical to SEQ ID NO: 13178

SEQ ID NO: 32475 - DNA, 203 bp, Homo sapiens; identical to SEQ ID NO: 13179

SEQ ID NO: 32476 - DNA, 203 bp, Homo sapiens; identical to SEQ ID NO: 13180

SEQ ID NO: 32477 - DNA, 203 bp, Homo sapiens; identical to SEQ ID NO: 13182

SEQ ID NO: 32478 - DNA, 203 bp, Homo sapiens; identical to SEQ ID NO: 13183

SEQ ID NO: 32479 - DNA, 203 bp, Homo sapiens; identical to SEQ ID NO: 13184

SEQ ID NO: 32480 - DNA, 203 bp, Homo sapiens; identical to SEQ ID NO: 13186

SEQ ID NO: 32481 - DNA, 203 bp, Homo sapiens; identical to SEQ ID NO: 13187

SEQ ID NO: 32482 - DNA, 203 bp, Homo sapiens; identical to SEQ ID NO: 13188

SEQ ID NO: 32483 - DNA, 203 bp, Homo sapiens; identical to SEQ ID NO: 13189

SEQ ID NO: 32484 - DNA, 203 bp, Homo sapiens; identical to SEQ ID NO: 13190

SEQ ID NO: 32485 - DNA, 203 bp, Homo sapiens; identical to SEQ ID NO: 13192

SEQ ID NO: 32486 - DNA, 203 bp, Homo sapiens; identical to SEQ ID NO: 13207

SEQ ID NO: 32487 - DNA, 203 bp, Homo sapiens; identical to SEQ ID NO: 13208

SEQ ID NO: 32488 - DNA, 203 bp, Homo sapiens; identical to SEQ ID NO: 13209

SEQ ID NO: 32489 - DNA, 203 bp, Homo sapiens; identical to SEQ ID NO: 13220

SEQ ID NO: 32490 - DNA, 203 bp, Homo sapiens; identical to SEQ ID NO: 13222

SEQ ID NO: 32491 - DNA, 203 bp, Homo sapiens; identical to SEQ ID NO: 13223

SEQ ID NO: 32492 - DNA, 203 bp, Homo sapiens; identical to SEQ ID NO: 13233

SEQ ID NO: 32493 - DNA, 203 bp, Homo sapiens; identical to SEQ ID NO: 13239

SEQ ID NO: 32494 - DNA, 203 bp, Homo sapiens; identical to SEQ ID NO: 13241

SEQ ID NO: 32495 - DNA, 203 bp, Homo sapiens; identical to SEQ ID NO: 13242

SEQ ID NO: 32496 - DNA, 203 bp, Homo sapiens; identical to SEQ ID NO: 13243

SEQ ID NO: 32497 - DNA, 203 bp, Homo sapiens; identical to SEQ ID NO: 13244

SEQ ID NO: 32498 - DNA, 203 bp, Homo sapiens; identical to SEQ ID NO: 13246

SEQ ID NO: 32499 - DNA, 203 bp, Homo sapiens; identical to SEQ ID NO: 13247

SEQ ID NO: 32500 - DNA, 203 bp, Homo sapiens; identical to SEQ ID NO: 13248

SEQ ID NO: 32501 - DNA, 203 bp, Homo sapiens; identical to SEQ ID NO: 13250

SEQ ID NO: 32502 - DNA, 203 bp, Homo sapiens; identical to SEQ ID NO: 13252

SEQ ID NO: 32503 - DNA, 203 bp, Homo sapiens; identical to SEQ ID NO: 13254

SEQ ID NO: 32504 - DNA, 203 bp, Homo sapiens; identical to SEQ ID NO: 13256

SEQ ID NO: 32505 - DNA, 203 bp, Homo sapiens; identical to SEQ ID NO: 13257

SEQ ID NO: 32506 - DNA, 203 bp, Homo sapiens; identical to SEQ ID NO: 13261

SEQ ID NO: 32507 - DNA, 203 bp, Homo sapiens; identical to SEQ ID NO: 13262

SEQ ID NO: 32508 - DNA, 203 bp, Homo sapiens; identical to SEQ ID NO: 13263

SEQ ID NO: 32509 - DNA, 203 bp, Homo sapiens; identical to SEQ ID NO: 13265

SEQ ID NO: 32510 - DNA, 203 bp, Homo sapiens; identical to SEQ ID NO: 13269

SEQ ID NO: 32511 - DNA, 203 bp, Homo sapiens; identical to SEQ ID NO: 13270

SEQ ID NO: 32512 - DNA, 203 bp, Homo sapiens; identical to SEQ ID NO: 13271

SEQ ID NO: 32513 - DNA, 203 bp, Homo sapiens; identical to SEQ ID NO: 13314

SEQ ID NO: 32514 - DNA, 203 bp, Homo sapiens; identical to SEQ ID NO: 13323

SEQ ID NO: 32515 - DNA, 203 bp, Homo sapiens; identical to SEQ ID NO: 13324

SEQ ID NO: 32516 - DNA, 203 bp, Homo sapiens; identical to SEQ ID NO: 13402

SEQ ID NO: 32517 - DNA, 203 bp, Homo sapiens; identical to SEQ ID NO: 13403

SEQ ID NO: 32518 - DNA, 203 bp, Homo sapiens; identical to SEQ ID NO: 13404

SEQ ID NO: 32519 - DNA, 203 bp, Homo sapiens; identical to SEQ ID NO: 13415

SEQ ID NO: 32520 - DNA, 203 bp, Homo sapiens; identical to SEQ ID NO: 13420

SEQ ID NO: 32521 - DNA, 203 bp, Homo sapiens; identical to SEQ ID NO: 13422

SEQ ID NO: 32522 - DNA, 203 bp, Homo sapiens; identical to SEQ ID NO: 13429

SEQ ID NO: 32523 - DNA, 203 bp, Homo sapiens; identical to SEQ ID NO: 13430

SEQ ID NO: 32524 - DNA, 203 bp, Homo sapiens; identical to SEQ ID NO: 13434

SEQ ID NO: 32525 - DNA, 203 bp, Homo sapiens; identical to SEQ ID NO: 13435

SEQ ID NO: 32526 - DNA, 203 bp, Homo sapiens; identical to SEQ ID NO: 13450

SEQ ID NO: 32527 - DNA, 203 bp, Homo sapiens; identical to SEQ ID NO: 13463

SEQ ID NO: 32528 - DNA, 203 bp, Homo sapiens; identical to SEQ ID NO: 13464

SEQ ID NO: 32529 - DNA, 203 bp, Homo sapiens; identical to SEQ ID NO: 13465

SEQ ID NO: 32530 - DNA, 203 bp, Homo sapiens; identical to SEQ ID NO: 13470

SEQ ID NO: 32531 - DNA, 203 bp, Homo sapiens; identical to SEQ ID NO: 13472

SEQ ID NO: 32532 - DNA, 203 bp, Homo sapiens; identical to SEQ ID NO: 13473

SEQ ID NO: 32533 - DNA, 203 bp, Homo sapiens; identical to SEQ ID NO: 13482

SEQ ID NO: 32534 - DNA, 203 bp, Homo sapiens; identical to SEQ ID NO: 13483

SEQ ID NO: 32535 - DNA, 203 bp, Homo sapiens; identical to SEQ ID NO: 13484

SEQ ID NO: 32536 - DNA, 203 bp, Homo sapiens; identical to SEQ ID NO: 13485

SEQ ID NO: 32537 - DNA, 203 bp, Homo sapiens; identical to SEQ ID NO: 13486

SEQ ID NO: 32538 - DNA, 203 bp, Homo sapiens; identical to SEQ ID NO: 13487

SEQ ID NO: 32539 - DNA, 203 bp, Homo sapiens; identical to SEQ ID NO: 13488

SEQ ID NO: 32540 - DNA, 203 bp, Homo sapiens; identical to SEQ ID NO: 13490

SEQ ID NO: 32541 - DNA, 203 bp, Homo sapiens; identical to SEQ ID NO: 13491

SEQ ID NO: 32542 - DNA, 203 bp, Homo sapiens; identical to SEQ ID NO: 13494

SEQ ID NO: 32543 - DNA, 203 bp, Homo sapiens; identical to SEQ ID NO: 13496

SEQ ID NO: 32544 - DNA, 203 bp, Homo sapiens; identical to SEQ ID NO: 13507

SEQ ID NO: 32545 - DNA, 203 bp, Homo sapiens; identical to SEQ ID NO: 13508

SEQ ID NO: 32546 - DNA, 203 bp, Homo sapiens; identical to SEQ ID NO: 13519

SEQ ID NO: 32547 - DNA, 203 bp, Homo sapiens; identical to SEQ ID NO: 13520

SEQ ID NO: 32548 - DNA, 203 bp, Homo sapiens; identical to SEQ ID NO: 13521

SEQ ID NO: 32549 - DNA, 203 bp, Homo sapiens; identical to SEQ ID NO: 13531

SEQ ID NO: 32550 - DNA, 203 bp, Homo sapiens; identical to SEQ ID NO: 13532

SEQ ID NO: 32551 - DNA, 203 bp, Homo sapiens; identical to SEQ ID NO: 13533

SEQ ID NO: 32552 - DNA, 203 bp, Homo sapiens; identical to SEQ ID NO: 13548

SEQ ID NO: 32553 - DNA, 203 bp, Homo sapiens; identical to SEQ ID NO: 13583

SEQ ID NO: 32554 - DNA, 203 bp, Homo sapiens; identical to SEQ ID NO: 13600

SEQ ID NO: 32555 - DNA, 203 bp, Homo sapiens; identical to SEQ ID NO: 13622

SEQ ID NO: 32556 - DNA, 203 bp, Homo sapiens; identical to SEQ ID NO: 13624

SEQ ID NO: 32557 - DNA, 203 bp, Homo sapiens; identical to SEQ ID NO: 13626

SEQ ID NO: 32558 - DNA, 203 bp, Homo sapiens; identical to SEQ ID NO: 13627

SEQ ID NO: 32559 - DNA, 203 bp, Homo sapiens; identical to SEQ ID NO: 13628

SEQ ID NO: 32560 - DNA, 203 bp, Homo sapiens; identical to SEQ ID NO: 13630

SEQ ID NO: 32561 - DNA, 203 bp, Homo sapiens; identical to SEQ ID NO: 13631

SEQ ID NO: 32562 - DNA, 203 bp, Homo sapiens; identical to SEQ ID NO: 13649

SEQ ID NO: 32563 - DNA, 203 bp, Homo sapiens; identical to SEQ ID NO: 13653

SEQ ID NO: 32564 - DNA, 203 bp, Homo sapiens; identical to SEQ ID NO: 13654

SEQ ID NO: 32565 - DNA, 203 bp, Homo sapiens; identical to SEQ ID NO: 13668

SEQ ID NO: 32566 - DNA, 203 bp, Homo sapiens; identical to SEQ ID NO: 13672

SEQ ID NO: 32567 - DNA, 203 bp, Homo sapiens; identical to SEQ ID NO: 13673

SEQ ID NO: 32568 - DNA, 203 bp, Homo sapiens; identical to SEQ ID NO: 13674

SEQ ID NO: 32569 - DNA, 203 bp, Homo sapiens; identical to SEQ ID NO: 13677

SEQ ID NO: 32570 - DNA, 203 bp, Homo sapiens; identical to SEQ ID NO: 13678

SEQ ID NO: 32571 - DNA, 203 bp, Homo sapiens; identical to SEQ ID NO: 13679

SEQ ID NO: 32572 - DNA, 203 bp, Homo sapiens; identical to SEQ ID NO: 13686

SEQ ID NO: 32573 - DNA, 203 bp, Homo sapiens; identical to SEQ ID NO: 13687

SEQ ID NO: 32574 - DNA, 203 bp, Homo sapiens; identical to SEQ ID NO: 13689

SEQ ID NO: 32575 - DNA, 203 bp, Homo sapiens; identical to SEQ ID NO: 13690

SEQ ID NO: 32576 - DNA, 203 bp, Homo sapiens; identical to SEQ ID NO: 13692

SEQ ID NO: 32577 - DNA, 203 bp, Homo sapiens; identical to SEQ ID NO: 13700

SEQ ID NO: 32578 - DNA, 203 bp, Homo sapiens; identical to SEQ ID NO: 13706

SEQ ID NO: 32579 - DNA, 203 bp, Homo sapiens; identical to SEQ ID NO: 13709

SEQ ID NO: 32580 - DNA, 203 bp, Homo sapiens; identical to SEQ ID NO: 13715

SEQ ID NO: 32581 - DNA, 203 bp, Homo sapiens; identical to SEQ ID NO: 13716

SEQ ID NO: 32582 - DNA, 203 bp, Homo sapiens; identical to SEQ ID NO: 13717

SEQ ID NO: 32583 - DNA, 203 bp, Homo sapiens; identical to SEQ ID NO: 13718

SEQ ID NO: 32584 - DNA, 203 bp, Homo sapiens; identical to SEQ ID NO: 13719

SEQ ID NO: 32585 - DNA, 203 bp, Homo sapiens; identical to SEQ ID NO: 13720

SEQ ID NO: 32586 - DNA, 203 bp, Homo sapiens; identical to SEQ ID NO: 13721

SEQ ID NO: 32587 - DNA, 203 bp, Homo sapiens; identical to SEQ ID NO: 13722

SEQ ID NO: 32588 - DNA, 203 bp, Homo sapiens; identical to SEQ ID NO: 13723

SEQ ID NO: 32589 - DNA, 203 bp, Homo sapiens; identical to SEQ ID NO: 13724

SEQ ID NO: 32590 - DNA, 203 bp, Homo sapiens; identical to SEQ ID NO: 13753

SEQ ID NO: 32591 - DNA, 203 bp, Homo sapiens; identical to SEQ ID NO: 13754

SEQ ID NO: 32592 - DNA, 203 bp, Homo sapiens; identical to SEQ ID NO: 13756

SEQ ID NO: 32593 - DNA, 203 bp, Homo sapiens; identical to SEQ ID NO: 13758

SEQ ID NO: 32594 - DNA, 203 bp, Homo sapiens; identical to SEQ ID NO: 13759

SEQ ID NO: 32595 - DNA, 203 bp, Homo sapiens; identical to SEQ ID NO: 13760

SEQ ID NO: 32596 - DNA, 203 bp, Homo sapiens; identical to SEQ ID NO: 13761

SEQ ID NO: 32597 - DNA, 203 bp, Homo sapiens; identical to SEQ ID NO: 13762

SEQ ID NO: 32598 - DNA, 203 bp, Homo sapiens; identical to SEQ ID NO: 13763

SEQ ID NO: 32599 - DNA, 203 bp, Homo sapiens; identical to SEQ ID NO: 13764

SEQ ID NO: 32600 - DNA, 203 bp, Homo sapiens; identical to SEQ ID NO: 13780

SEQ ID NO: 32601 - DNA, 203 bp, Homo sapiens; identical to SEQ ID NO: 13781

SEQ ID NO: 32602 - DNA, 203 bp, Homo sapiens; identical to SEQ ID NO: 13790

SEQ ID NO: 32603 - DNA, 203 bp, Homo sapiens; identical to SEQ ID NO: 13792

SEQ ID NO: 32604 - DNA, 203 bp, Homo sapiens; identical to SEQ ID NO: 13793

SEQ ID NO: 32605 - DNA, 203 bp, Homo sapiens; identical to SEQ ID NO: 13794

SEQ ID NO: 32606 - DNA, 203 bp, Homo sapiens; identical to SEQ ID NO: 13795

SEQ ID NO: 32607 - DNA, 203 bp, Homo sapiens; identical to SEQ ID NO: 13798

SEQ ID NO: 32608 - DNA, 203 bp, Homo sapiens; identical to SEQ ID NO: 13799

SEQ ID NO: 32609 - DNA, 203 bp, Homo sapiens; identical to SEQ ID NO: 13800

SEQ ID NO: 32610 - DNA, 203 bp, Homo sapiens; identical to SEQ ID NO: 13810

SEQ ID NO: 32611 - DNA, 203 bp, Homo sapiens; identical to SEQ ID NO: 13811

SEQ ID NO: 32612 - DNA, 203 bp, Homo sapiens; identical to SEQ ID NO: 13813

SEQ ID NO: 32613 - DNA, 203 bp, Homo sapiens; identical to SEQ ID NO: 13814

SEQ ID NO: 32614 - DNA, 203 bp, Homo sapiens; identical to SEQ ID NO: 13815

SEQ ID NO: 32615 - DNA, 203 bp, Homo sapiens; identical to SEQ ID NO: 13816

SEQ ID NO: 32616 - DNA, 203 bp, Homo sapiens; identical to SEQ ID NO: 13819

SEQ ID NO: 32617 - DNA, 203 bp, Homo sapiens; identical to SEQ ID NO: 13823

SEQ ID NO: 32618 - DNA, 203 bp, Homo sapiens; identical to SEQ ID NO: 13824

SEQ ID NO: 32619 - DNA, 203 bp, Homo sapiens; identical to SEQ ID NO: 13827

SEQ ID NO: 32620 - DNA, 203 bp, Homo sapiens; identical to SEQ ID NO: 13828

SEQ ID NO: 32621 - DNA, 203 bp, Homo sapiens; identical to SEQ ID NO: 13829

SEQ ID NO: 32622 - DNA, 203 bp, Homo sapiens; identical to SEQ ID NO: 13830

SEQ ID NO: 32623 - DNA, 203 bp, Homo sapiens; identical to SEQ ID NO: 13831

SEQ ID NO: 32624 - DNA, 203 bp, Homo sapiens; identical to SEQ ID NO: 13832

SEQ ID NO: 32625 - DNA, 203 bp, Homo sapiens; identical to SEQ ID NO: 13833

SEQ ID NO: 32626 - DNA, 203 bp, Homo sapiens; identical to SEQ ID NO: 13834

SEQ ID NO: 32627 - DNA, 203 bp, Homo sapiens; identical to SEQ ID NO: 13836

SEQ ID NO: 32628 - DNA, 203 bp, Homo sapiens; identical to SEQ ID NO: 13837

SEQ ID NO: 32629 - DNA, 203 bp, Homo sapiens; identical to SEQ ID NO: 13841

SEQ ID NO: 32630 - DNA, 203 bp, Homo sapiens; identical to SEQ ID NO: 13843

SEQ ID NO: 32631 - DNA, 203 bp, Homo sapiens; identical to SEQ ID NO: 13844

SEQ ID NO: 32632 - DNA, 203 bp, Homo sapiens; identical to SEQ ID NO: 13861

SEQ ID NO: 32633 - DNA, 203 bp, Homo sapiens; identical to SEQ ID NO: 13865

SEQ ID NO: 32634 - DNA, 203 bp, Homo sapiens; identical to SEQ ID NO: 13868

SEQ ID NO: 32635 - DNA, 203 bp, Homo sapiens; identical to SEQ ID NO: 13871

SEQ ID NO: 32636 - DNA, 203 bp, Homo sapiens; identical to SEQ ID NO: 13872

SEQ ID NO: 32637 - DNA, 203 bp, Homo sapiens; identical to SEQ ID NO: 13879

SEQ ID NO: 32638 - DNA, 203 bp, Homo sapiens; identical to SEQ ID NO: 13882

SEQ ID NO: 32639 - DNA, 203 bp, Homo sapiens; identical to SEQ ID NO: 13920

SEQ ID NO: 32640 - DNA, 203 bp, Homo sapiens; identical to SEQ ID NO: 13922

SEQ ID NO: 32641 - DNA, 203 bp, Homo sapiens; identical to SEQ ID NO: 13929

SEQ ID NO: 32642 - DNA, 203 bp, Homo sapiens; identical to SEQ ID NO: 13945

SEQ ID NO: 32643 - DNA, 203 bp, Homo sapiens; identical to SEQ ID NO: 13954

SEQ ID NO: 32644 - DNA, 203 bp, Homo sapiens; identical to SEQ ID NO: 13963

SEQ ID NO: 32645 - DNA, 203 bp, Homo sapiens; identical to SEQ ID NO: 13964

SEQ ID NO: 32646 - DNA, 203 bp, Homo sapiens; identical to SEQ ID NO: 13965

SEQ ID NO: 32647 - DNA, 203 bp, Homo sapiens; identical to SEQ ID NO: 13994

SEQ ID NO: 32648 - DNA, 203 bp, Homo sapiens; identical to SEQ ID NO: 14004

SEQ ID NO: 32649 - DNA, 203 bp, Homo sapiens; identical to SEQ ID NO: 14026

SEQ ID NO: 32650 - DNA, 203 bp, Homo sapiens; identical to SEQ ID NO: 14027

SEQ ID NO: 32651 - DNA, 203 bp, Homo sapiens; identical to SEQ ID NO: 14029

SEQ ID NO: 32652 - DNA, 203 bp, Homo sapiens; identical to SEQ ID NO: 14032

SEQ ID NO: 32653 - DNA, 203 bp, Homo sapiens; identical to SEQ ID NO: 14033

SEQ ID NO: 32654 - DNA, 203 bp, Homo sapiens; identical to SEQ ID NO: 14034

SEQ ID NO: 32655 - DNA, 203 bp, Homo sapiens; identical to SEQ ID NO: 14036

SEQ ID NO: 32656 - DNA, 203 bp, Homo sapiens; identical to SEQ ID NO: 14037

SEQ ID NO: 32657 - DNA, 203 bp, Homo sapiens; identical to SEQ ID NO: 14038

SEQ ID NO: 32658 - DNA, 203 bp, Homo sapiens; identical to SEQ ID NO: 14039

SEQ ID NO: 32659 - DNA, 203 bp, Homo sapiens; identical to SEQ ID NO: 14042

SEQ ID NO: 32660 - DNA, 203 bp, Homo sapiens; identical to SEQ ID NO: 14043

SEQ ID NO: 32661 - DNA, 203 bp, Homo sapiens; identical to SEQ ID NO: 14055

SEQ ID NO: 32662 - DNA, 203 bp, Homo sapiens; identical to SEQ ID NO: 14058

SEQ ID NO: 32663 - DNA, 203 bp, Homo sapiens; identical to SEQ ID NO: 14059

SEQ ID NO: 32664 - DNA, 203 bp, Homo sapiens; identical to SEQ ID NO: 14061

SEQ ID NO: 32665 - DNA, 203 bp, Homo sapiens; identical to SEQ ID NO: 14063

SEQ ID NO: 32666 - DNA, 203 bp, Homo sapiens; identical to SEQ ID NO: 14085

SEQ ID NO: 32667 - DNA, 203 bp, Homo sapiens; identical to SEQ ID NO: 14086

SEQ ID NO: 32668 - DNA, 203 bp, Homo sapiens; identical to SEQ ID NO: 14087

SEQ ID NO: 32669 - DNA, 203 bp, Homo sapiens; identical to SEQ ID NO: 14088

SEQ ID NO: 32670 - DNA, 203 bp, Homo sapiens; identical to SEQ ID NO: 14100

SEQ ID NO: 32671 - DNA, 203 bp, Homo sapiens; identical to SEQ ID NO: 14111

SEQ ID NO: 32672 - DNA, 203 bp, Homo sapiens; identical to SEQ ID NO: 14112

SEQ ID NO: 32673 - DNA, 203 bp, Homo sapiens; identical to SEQ ID NO: 14113

SEQ ID NO: 32674 - DNA, 203 bp, Homo sapiens; identical to SEQ ID NO: 14118

SEQ ID NO: 32675 - DNA, 203 bp, Homo sapiens; identical to SEQ ID NO: 14119

SEQ ID NO: 32676 - DNA, 203 bp, Homo sapiens; identical to SEQ ID NO: 14120

SEQ ID NO: 32677 - DNA, 203 bp, Homo sapiens; identical to SEQ ID NO: 14121

SEQ ID NO: 32678 - DNA, 203 bp, Homo sapiens; identical to SEQ ID NO: 14125

SEQ ID NO: 32679 - DNA, 203 bp, Homo sapiens; identical to SEQ ID NO: 14126

SEQ ID NO: 32680 - DNA, 203 bp, Homo sapiens; identical to SEQ ID NO: 14127

SEQ ID NO: 32681 - DNA, 203 bp, Homo sapiens; identical to SEQ ID NO: 14130

SEQ ID NO: 32682 - DNA, 203 bp, Homo sapiens; identical to SEQ ID NO: 14135

SEQ ID NO: 32683 - DNA, 203 bp, Homo sapiens; identical to SEQ ID NO: 14136

SEQ ID NO: 32684 - DNA, 203 bp, Homo sapiens; identical to SEQ ID NO: 14137

SEQ ID NO: 32685 - DNA, 203 bp, Homo sapiens; identical to SEQ ID NO: 14144

SEQ ID NO: 32686 - DNA, 203 bp, Homo sapiens; identical to SEQ ID NO: 14153

SEQ ID NO: 32687 - DNA, 203 bp, Homo sapiens; identical to SEQ ID NO: 14154

SEQ ID NO: 32688 - DNA, 203 bp, Homo sapiens; identical to SEQ ID NO: 14155

SEQ ID NO: 32689 - DNA, 203 bp, Homo sapiens; identical to SEQ ID NO: 14156

SEQ ID NO: 32690 - DNA, 203 bp, Homo sapiens; identical to SEQ ID NO: 14158

SEQ ID NO: 32691 - DNA, 203 bp, Homo sapiens; identical to SEQ ID NO: 14159

SEQ ID NO: 32692 - DNA, 203 bp, Homo sapiens; identical to SEQ ID NO: 14161

SEQ ID NO: 32693 - DNA, 203 bp, Homo sapiens; identical to SEQ ID NO: 14162

SEQ ID NO: 32694 - DNA, 203 bp, Homo sapiens; identical to SEQ ID NO: 14163

SEQ ID NO: 32695 - DNA, 203 bp, Homo sapiens; identical to SEQ ID NO: 14165

SEQ ID NO: 32696 - DNA, 203 bp, Homo sapiens; identical to SEQ ID NO: 14166

SEQ ID NO: 32697 - DNA, 203 bp, Homo sapiens; identical to SEQ ID NO: 14167

SEQ ID NO: 32698 - DNA, 203 bp, Homo sapiens; identical to SEQ ID NO: 14206

SEQ ID NO: 32699 - DNA, 203 bp, Homo sapiens; identical to SEQ ID NO: 14208

SEQ ID NO: 32700 - DNA, 203 bp, Homo sapiens; identical to SEQ ID NO: 14210

SEQ ID NO: 32701 - DNA, 203 bp, Homo sapiens; identical to SEQ ID NO: 14218

SEQ ID NO: 32702 - DNA, 203 bp, Homo sapiens; identical to SEQ ID NO: 14242

SEQ ID NO: 32703 - DNA, 203 bp, Homo sapiens; identical to SEQ ID NO: 14244

SEQ ID NO: 32704 - DNA, 203 bp, Homo sapiens; identical to SEQ ID NO: 14245

SEQ ID NO: 32705 - DNA, 203 bp, Homo sapiens; identical to SEQ ID NO: 14275

SEQ ID NO: 32706 - DNA, 203 bp, Homo sapiens; identical to SEQ ID NO: 14329

SEQ ID NO: 32707 - DNA, 203 bp, Homo sapiens; identical to SEQ ID NO: 14330

SEQ ID NO: 32708 - DNA, 203 bp, Homo sapiens; identical to SEQ ID NO: 14331

SEQ ID NO: 32709 - DNA, 203 bp, Homo sapiens; identical to SEQ ID NO: 14332

SEQ ID NO: 32710 - DNA, 203 bp, Homo sapiens; identical to SEQ ID NO: 14334

SEQ ID NO: 32711 - DNA, 203 bp, Homo sapiens; identical to SEQ ID NO: 14339

SEQ ID NO: 32712 - DNA, 203 bp, Homo sapiens; identical to SEQ ID NO: 14342

SEQ ID NO: 32713 - DNA, 203 bp, Homo sapiens; identical to SEQ ID NO: 14343

SEQ ID NO: 32714 - DNA, 203 bp, Homo sapiens; identical to SEQ ID NO: 14344

SEQ ID NO: 32715 - DNA, 203 bp, Homo sapiens; identical to SEQ ID NO: 14346

SEQ ID NO: 32716 - DNA, 203 bp, Homo sapiens; identical to SEQ ID NO: 14347

SEQ ID NO: 32717 - DNA, 203 bp, Homo sapiens; identical to SEQ ID NO: 14349

SEQ ID NO: 32718 - DNA, 203 bp, Homo sapiens; identical to SEQ ID NO: 14352

SEQ ID NO: 32719 - DNA, 203 bp, Homo sapiens; identical to SEQ ID NO: 14376

SEQ ID NO: 32720 - DNA, 203 bp, Homo sapiens; identical to SEQ ID NO: 14377

SEQ ID NO: 32721 - DNA, 203 bp, Homo sapiens; identical to SEQ ID NO: 14379

SEQ ID NO: 32722 - DNA, 203 bp, Homo sapiens; identical to SEQ ID NO: 14380

SEQ ID NO: 32723 - DNA, 203 bp, Homo sapiens; identical to SEQ ID NO: 14382

SEQ ID NO: 32724 - DNA, 203 bp, Homo sapiens; identical to SEQ ID NO: 14384

SEQ ID NO: 32725 - DNA, 203 bp, Homo sapiens; identical to SEQ ID NO: 14387

SEQ ID NO: 32726 - DNA, 203 bp, Homo sapiens; identical to SEQ ID NO: 14389

SEQ ID NO: 32727 - DNA, 203 bp, Homo sapiens; identical to SEQ ID NO: 14390

SEQ ID NO: 32728 - DNA, 203 bp, Homo sapiens; identical to SEQ ID NO: 14391

SEQ ID NO: 32729 - DNA, 203 bp, Homo sapiens; identical to SEQ ID NO: 14395

SEQ ID NO: 32730 - DNA, 203 bp, Homo sapiens; identical to SEQ ID NO: 14397

SEQ ID NO: 32731 - DNA, 203 bp, Homo sapiens; identical to SEQ ID NO: 14398

SEQ ID NO: 32732 - DNA, 203 bp, Homo sapiens; identical to SEQ ID NO: 14400

SEQ ID NO: 32733 - DNA, 203 bp, Homo sapiens; identical to SEQ ID NO: 14402

SEQ ID NO: 32734 - DNA, 203 bp, Homo sapiens; identical to SEQ ID NO: 14404

SEQ ID NO: 32735 - DNA, 203 bp, Homo sapiens; identical to SEQ ID NO: 14405

SEQ ID NO: 32736 - DNA, 203 bp, Homo sapiens; identical to SEQ ID NO: 14407

SEQ ID NO: 32737 - DNA, 203 bp, Homo sapiens; identical to SEQ ID NO: 14408

SEQ ID NO: 32738 - DNA, 203 bp, Homo sapiens; identical to SEQ ID NO: 14410

SEQ ID NO: 32739 - DNA, 203 bp, Homo sapiens; identical to SEQ ID NO: 14412

SEQ ID NO: 32740 - DNA, 203 bp, Homo sapiens; identical to SEQ ID NO: 14413

SEQ ID NO: 32741 - DNA, 203 bp, Homo sapiens; identical to SEQ ID NO: 14423

SEQ ID NO: 32742 - DNA, 203 bp, Homo sapiens; identical to SEQ ID NO: 14424

SEQ ID NO: 32743 - DNA, 203 bp, Homo sapiens; identical to SEQ ID NO: 14425

SEQ ID NO: 32744 - DNA, 203 bp, Homo sapiens; identical to SEQ ID NO: 14427

SEQ ID NO: 32745 - DNA, 203 bp, Homo sapiens; identical to SEQ ID NO: 14428

SEQ ID NO: 32746 - DNA, 203 bp, Homo sapiens; identical to SEQ ID NO: 14429

SEQ ID NO: 32747 - DNA, 203 bp, Homo sapiens; identical to SEQ ID NO: 14430

SEQ ID NO: 32748 - DNA, 203 bp, Homo sapiens; identical to SEQ ID NO: 14432

SEQ ID NO: 32749 - DNA, 203 bp, Homo sapiens; identical to SEQ ID NO: 14434

SEQ ID NO: 32750 - DNA, 203 bp, Homo sapiens; identical to SEQ ID NO: 14435

SEQ ID NO: 32751 - DNA, 203 bp, Homo sapiens; identical to SEQ ID NO: 14436

SEQ ID NO: 32752 - DNA, 203 bp, Homo sapiens; identical to SEQ ID NO: 14437

SEQ ID NO: 32753 - DNA, 203 bp, Homo sapiens; identical to SEQ ID NO: 14438

SEQ ID NO: 32754 - DNA, 203 bp, Homo sapiens; identical to SEQ ID NO: 14463

SEQ ID NO: 32755 - DNA, 203 bp, Homo sapiens; identical to SEQ ID NO: 14540

SEQ ID NO: 32756 - DNA, 203 bp, Homo sapiens; identical to SEQ ID NO: 14603

SEQ ID NO: 32757 - DNA, 203 bp, Homo sapiens; identical to SEQ ID NO: 14605

SEQ ID NO: 32758 - DNA, 203 bp, Homo sapiens; identical to SEQ ID NO: 14609

SEQ ID NO: 32759 - DNA, 203 bp, Homo sapiens; identical to SEQ ID NO: 14613

SEQ ID NO: 32760 - DNA, 203 bp, Homo sapiens; identical to SEQ ID NO: 14615

SEQ ID NO: 32761 - DNA, 203 bp, Homo sapiens; identical to SEQ ID NO: 14700

SEQ ID NO: 32762 - DNA, 203 bp, Homo sapiens; identical to SEQ ID NO: 14706

SEQ ID NO: 32763 - DNA, 203 bp, Homo sapiens; identical to SEQ ID NO: 15251

SEQ ID NO: 32764 - DNA, 203 bp, Homo sapiens; identical to SEQ ID NO: 15252

SEQ ID NO: 32765 - DNA, 203 bp, Homo sapiens; identical to SEQ ID NO: 15265

SEQ ID NO: 32766 - DNA, 203 bp, Homo sapiens; identical to SEQ ID NO: 15269

SEQ ID NO: 32767 - DNA, 203 bp, Homo sapiens; identical to SEQ ID NO: 15275

SEQ ID NO: 32768 - DNA, 203 bp, Homo sapiens; identical to SEQ ID NO: 15281

SEQ ID NO: 32769 - DNA, 203 bp, Homo sapiens; identical to SEQ ID NO: 15287

SEQ ID NO: 32770 - DNA, 203 bp, Homo sapiens; identical to SEQ ID NO: 15291

SEQ ID NO: 32771 - DNA, 203 bp, Homo sapiens; identical to SEQ ID NO: 15292

SEQ ID NO: 32772 - DNA, 203 bp, Homo sapiens; identical to SEQ ID NO: 15303

SEQ ID NO: 32773 - DNA, 203 bp, Homo sapiens; identical to SEQ ID NO: 15307

SEQ ID NO: 32774 - DNA, 203 bp, Homo sapiens; identical to SEQ ID NO: 15395

SEQ ID NO: 32775 - DNA, 203 bp, Homo sapiens; identical to SEQ ID NO: 15398

SEQ ID NO: 32776 - DNA, 203 bp, Homo sapiens; identical to SEQ ID NO: 15407

SEQ ID NO: 32777 - DNA, 203 bp, Homo sapiens; identical to SEQ ID NO: 15572

SEQ ID NO: 32778 - DNA, 203 bp, Homo sapiens; identical to SEQ ID NO: 15573

SEQ ID NO: 32779 - DNA, 203 bp, Homo sapiens; identical to SEQ ID NO: 15575

SEQ ID NO: 32780 - DNA, 203 bp, Homo sapiens; identical to SEQ ID NO: 15576

SEQ ID NO: 32781 - DNA, 203 bp, Homo sapiens; identical to SEQ ID NO: 15578

SEQ ID NO: 32782 - DNA, 203 bp, Homo sapiens; identical to SEQ ID NO: 15580

SEQ ID NO: 32783 - DNA, 203 bp, Homo sapiens; identical to SEQ ID NO: 15581

SEQ ID NO: 32784 - DNA, 203 bp, Homo sapiens; identical to SEQ ID NO: 15582

SEQ ID NO: 32785 - DNA, 203 bp, Homo sapiens; identical to SEQ ID NO: 15584

SEQ ID NO: 32786 - DNA, 203 bp, Homo sapiens; identical to SEQ ID NO: 15586

SEQ ID NO: 32787 - DNA, 203 bp, Homo sapiens; identical to SEQ ID NO: 15587

SEQ ID NO: 32788 - DNA, 203 bp, Homo sapiens; identical to SEQ ID NO: 15588

SEQ ID NO: 32789 - DNA, 203 bp, Homo sapiens; identical to SEQ ID NO: 15589

SEQ ID NO: 32790 - DNA, 203 bp, Homo sapiens; identical to SEQ ID NO: 15591

SEQ ID NO: 32791 - DNA, 203 bp, Homo sapiens; identical to SEQ ID NO: 15592

SEQ ID NO: 32792 - DNA, 203 bp, Homo sapiens; identical to SEQ ID NO: 15606

SEQ ID NO: 32793 - DNA, 203 bp, Homo sapiens; identical to SEQ ID NO: 15617

SEQ ID NO: 32794 - DNA, 203 bp, Homo sapiens; identical to SEQ ID NO: 15618

SEQ ID NO: 32795 - DNA, 203 bp, Homo sapiens; identical to SEQ ID NO: 15620

SEQ ID NO: 32796 - DNA, 203 bp, Homo sapiens; identical to SEQ ID NO: 15623

SEQ ID NO: 32797 - DNA, 203 bp, Homo sapiens; identical to SEQ ID NO: 15629

SEQ ID NO: 32798 - DNA, 203 bp, Homo sapiens; identical to SEQ ID NO: 15632

SEQ ID NO: 32799 - DNA, 203 bp, Homo sapiens; identical to SEQ ID NO: 15636

SEQ ID NO: 32800 - DNA, 203 bp, Homo sapiens; identical to SEQ ID NO: 15639

SEQ ID NO: 32801 - DNA, 203 bp, Homo sapiens; identical to SEQ ID NO: 15640

SEQ ID NO: 32802 - DNA, 203 bp, Homo sapiens; identical to SEQ ID NO: 15641

SEQ ID NO: 32803 - DNA, 203 bp, Homo sapiens; identical to SEQ ID NO: 15643

SEQ ID NO: 32804 - DNA, 203 bp, Homo sapiens; identical to SEQ ID NO: 15644

SEQ ID NO: 32805 - DNA, 203 bp, Homo sapiens; identical to SEQ ID NO: 15645

SEQ ID NO: 32806 - DNA, 203 bp, Homo sapiens; identical to SEQ ID NO: 15646

SEQ ID NO: 32807 - DNA, 203 bp, Homo sapiens; identical to SEQ ID NO: 15647

SEQ ID NO: 32808 - DNA, 203 bp, Homo sapiens; identical to SEQ ID NO: 15648

SEQ ID NO: 32809 - DNA, 203 bp, Homo sapiens; identical to SEQ ID NO: 15650

SEQ ID NO: 32810 - DNA, 203 bp, Homo sapiens; identical to SEQ ID NO: 15651

SEQ ID NO: 32811 - DNA, 203 bp, Homo sapiens; identical to SEQ ID NO: 15652

SEQ ID NO: 32812 - DNA, 203 bp, Homo sapiens; identical to SEQ ID NO: 15653

SEQ ID NO: 32813 - DNA, 203 bp, Homo sapiens; identical to SEQ ID NO: 15655

SEQ ID NO: 32814 - DNA, 203 bp, Homo sapiens; identical to SEQ ID NO: 15656

SEQ ID NO: 32815 - DNA, 203 bp, Homo sapiens; identical to SEQ ID NO: 15657

SEQ ID NO: 32816 - DNA, 203 bp, Homo sapiens; identical to SEQ ID NO: 15658

SEQ ID NO: 32817 - DNA, 203 bp, Homo sapiens; identical to SEQ ID NO: 15659

SEQ ID NO: 32818 - DNA, 203 bp, Homo sapiens; identical to SEQ ID NO: 15660

SEQ ID NO: 32819 - DNA, 203 bp, Homo sapiens; identical to SEQ ID NO: 15661

SEQ ID NO: 32820 - DNA, 203 bp, Homo sapiens; identical to SEQ ID NO: 15662

SEQ ID NO: 32821 - DNA, 203 bp, Homo sapiens; identical to SEQ ID NO: 15683

SEQ ID NO: 32822 - DNA, 203 bp, Homo sapiens; identical to SEQ ID NO: 15693

SEQ ID NO: 32823 - DNA, 203 bp, Homo sapiens; identical to SEQ ID NO: 15694

SEQ ID NO: 32824 - DNA, 203 bp, Homo sapiens; identical to SEQ ID NO: 15697

SEQ ID NO: 32825 - DNA, 203 bp, Homo sapiens; identical to SEQ ID NO: 15698

SEQ ID NO: 32826 - DNA, 203 bp, Homo sapiens; identical to SEQ ID NO: 15699

SEQ ID NO: 32827 - DNA, 203 bp, Homo sapiens; identical to SEQ ID NO: 15723

SEQ ID NO: 32828 - DNA, 203 bp, Homo sapiens; identical to SEQ ID NO: 15737

SEQ ID NO: 32829 - DNA, 203 bp, Homo sapiens; identical to SEQ ID NO: 15743

SEQ ID NO: 32830 - DNA, 203 bp, Homo sapiens; identical to SEQ ID NO: 15756

SEQ ID NO: 32831 - DNA, 203 bp, Homo sapiens; identical to SEQ ID NO: 15760

SEQ ID NO: 32832 - DNA, 203 bp, Homo sapiens; identical to SEQ ID NO: 15761

SEQ ID NO: 32833 - DNA, 203 bp, Homo sapiens; identical to SEQ ID NO: 15762

SEQ ID NO: 32834 - DNA, 203 bp, Homo sapiens; identical to SEQ ID NO: 15763

SEQ ID NO: 32835 - DNA, 203 bp, Homo sapiens; identical to SEQ ID NO: 15809

SEQ ID NO: 32836 - DNA, 203 bp, Homo sapiens; identical to SEQ ID NO: 15810

SEQ ID NO: 32837 - DNA, 203 bp, Homo sapiens; identical to SEQ ID NO: 15817

SEQ ID NO: 32838 - DNA, 203 bp, Homo sapiens; identical to SEQ ID NO: 15819

SEQ ID NO: 32839 - DNA, 203 bp, Homo sapiens; identical to SEQ ID NO: 15823

SEQ ID NO: 32840 - DNA, 203 bp, Homo sapiens; identical to SEQ ID NO: 15824

SEQ ID NO: 32841 - DNA, 203 bp, Homo sapiens; identical to SEQ ID NO: 15826

SEQ ID NO: 32842 - DNA, 203 bp, Homo sapiens; identical to SEQ ID NO: 15831

SEQ ID NO: 32843 - DNA, 203 bp, Homo sapiens; identical to SEQ ID NO: 15832

SEQ ID NO: 32844 - DNA, 203 bp, Homo sapiens; identical to SEQ ID NO: 15834

SEQ ID NO: 32845 - DNA, 203 bp, Homo sapiens; identical to SEQ ID NO: 15836

SEQ ID NO: 32846 - DNA, 203 bp, Homo sapiens; identical to SEQ ID NO: 15838

SEQ ID NO: 32847 - DNA, 203 bp, Homo sapiens; identical to SEQ ID NO: 15839

SEQ ID NO: 32848 - DNA, 203 bp, Homo sapiens; identical to SEQ ID NO: 15840

SEQ ID NO: 32849 - DNA, 203 bp, Homo sapiens; identical to SEQ ID NO: 15843

SEQ ID NO: 32850 - DNA, 203 bp, Homo sapiens; identical to SEQ ID NO: 15846

SEQ ID NO: 32851 - DNA, 203 bp, Homo sapiens; identical to SEQ ID NO: 15847

SEQ ID NO: 32852 - DNA, 203 bp, Homo sapiens; identical to SEQ ID NO: 15848

SEQ ID NO: 32853 - DNA, 203 bp, Homo sapiens; identical to SEQ ID NO: 15849

SEQ ID NO: 32854 - DNA, 203 bp, Homo sapiens; identical to SEQ ID NO: 15851

SEQ ID NO: 32855 - DNA, 203 bp, Homo sapiens; identical to SEQ ID NO: 15855

SEQ ID NO: 32856 - DNA, 203 bp, Homo sapiens; identical to SEQ ID NO: 15857

SEQ ID NO: 32857 - DNA, 203 bp, Homo sapiens; identical to SEQ ID NO: 15862

SEQ ID NO: 32858 - DNA, 203 bp, Homo sapiens; identical to SEQ ID NO: 15863

SEQ ID NO: 32859 - DNA, 203 bp, Homo sapiens; identical to SEQ ID NO: 15865

SEQ ID NO: 32860 - DNA, 203 bp, Homo sapiens; identical to SEQ ID NO: 15867

SEQ ID NO: 32861 - DNA, 203 bp, Homo sapiens; identical to SEQ ID NO: 15870

SEQ ID NO: 32862 - DNA, 203 bp, Homo sapiens; identical to SEQ ID NO: 15873

SEQ ID NO: 32863 - DNA, 203 bp, Homo sapiens; identical to SEQ ID NO: 15875

SEQ ID NO: 32864 - DNA, 203 bp, Homo sapiens; identical to SEQ ID NO: 15876

SEQ ID NO: 32865 - DNA, 203 bp, Homo sapiens; identical to SEQ ID NO: 15880

SEQ ID NO: 32866 - DNA, 203 bp, Homo sapiens; identical to SEQ ID NO: 15881

SEQ ID NO: 32867 - DNA, 203 bp, Homo sapiens; identical to SEQ ID NO: 15882

SEQ ID NO: 32868 - DNA, 203 bp, Homo sapiens; identical to SEQ ID NO: 15885

SEQ ID NO: 32869 - DNA, 203 bp, Homo sapiens; identical to SEQ ID NO: 15886

SEQ ID NO: 32870 - DNA, 203 bp, Homo sapiens; identical to SEQ ID NO: 15889

SEQ ID NO: 32871 - DNA, 203 bp, Homo sapiens; identical to SEQ ID NO: 15890

SEQ ID NO: 32872 - DNA, 203 bp, Homo sapiens; identical to SEQ ID NO: 15891

SEQ ID NO: 32873 - DNA, 203 bp, Homo sapiens; identical to SEQ ID NO: 15893

SEQ ID NO: 32874 - DNA, 203 bp, Homo sapiens; identical to SEQ ID NO: 15894

SEQ ID NO: 32875 - DNA, 203 bp, Homo sapiens; identical to SEQ ID NO: 15898

SEQ ID NO: 32876 - DNA, 203 bp, Homo sapiens; identical to SEQ ID NO: 15899

SEQ ID NO: 32877 - DNA, 203 bp, Homo sapiens; identical to SEQ ID NO: 15902

SEQ ID NO: 32878 - DNA, 203 bp, Homo sapiens; identical to SEQ ID NO: 15903

SEQ ID NO: 32879 - DNA, 203 bp, Homo sapiens; identical to SEQ ID NO: 15904

SEQ ID NO: 32880 - DNA, 203 bp, Homo sapiens; identical to SEQ ID NO: 15905

SEQ ID NO: 32881 - DNA, 203 bp, Homo sapiens; identical to SEQ ID NO: 15907

SEQ ID NO: 32882 - DNA, 203 bp, Homo sapiens; identical to SEQ ID NO: 15908

SEQ ID NO: 32883 - DNA, 203 bp, Homo sapiens; identical to SEQ ID NO: 15909

SEQ ID NO: 32884 - DNA, 203 bp, Homo sapiens; identical to SEQ ID NO: 15910

SEQ ID NO: 32885 - DNA, 203 bp, Homo sapiens; identical to SEQ ID NO: 15911

SEQ ID NO: 32886 - DNA, 203 bp, Homo sapiens; identical to SEQ ID NO: 15912

SEQ ID NO: 32887 - DNA, 203 bp, Homo sapiens; identical to SEQ ID NO: 15913

SEQ ID NO: 32888 - DNA, 203 bp, Homo sapiens; identical to SEQ ID NO: 15914

SEQ ID NO: 32889 - DNA, 203 bp, Homo sapiens; identical to SEQ ID NO: 15915

SEQ ID NO: 32890 - DNA, 203 bp, Homo sapiens; identical to SEQ ID NO: 15916

SEQ ID NO: 32891 - DNA, 203 bp, Homo sapiens; identical to SEQ ID NO: 15917

SEQ ID NO: 32892 - DNA, 203 bp, Homo sapiens; identical to SEQ ID NO: 15918

SEQ ID NO: 32893 - DNA, 203 bp, Homo sapiens; identical to SEQ ID NO: 15919

SEQ ID NO: 32894 - DNA, 203 bp, Homo sapiens; identical to SEQ ID NO: 15920

SEQ ID NO: 32895 - DNA, 203 bp, Homo sapiens; identical to SEQ ID NO: 15921

SEQ ID NO: 32896 - DNA, 203 bp, Homo sapiens; identical to SEQ ID NO: 15922

SEQ ID NO: 32897 - DNA, 203 bp, Homo sapiens; identical to SEQ ID NO: 15923

SEQ ID NO: 32898 - DNA, 203 bp, Homo sapiens; identical to SEQ ID NO: 15924

SEQ ID NO: 32899 - DNA, 203 bp, Homo sapiens; identical to SEQ ID NO: 15925

SEQ ID NO: 32900 - DNA, 203 bp, Homo sapiens; identical to SEQ ID NO: 15926

SEQ ID NO: 32901 - DNA, 203 bp, Homo sapiens; identical to SEQ ID NO: 15927

SEQ ID NO: 32902 - DNA, 203 bp, Homo sapiens; identical to SEQ ID NO: 15928

SEQ ID NO: 32903 - DNA, 203 bp, Homo sapiens; identical to SEQ ID NO: 15929

SEQ ID NO: 32904 - DNA, 203 bp, Homo sapiens; identical to SEQ ID NO: 15930

SEQ ID NO: 32905 - DNA, 203 bp, Homo sapiens; identical to SEQ ID NO: 15932

SEQ ID NO: 32906 - DNA, 203 bp, Homo sapiens; identical to SEQ ID NO: 15933

SEQ ID NO: 32907 - DNA, 203 bp, Homo sapiens; identical to SEQ ID NO: 15934

SEQ ID NO: 32908 - DNA, 203 bp, Homo sapiens; identical to SEQ ID NO: 15937

SEQ ID NO: 32909 - DNA, 203 bp, Homo sapiens; identical to SEQ ID NO: 15938

SEQ ID NO: 32910 - DNA, 203 bp, Homo sapiens; identical to SEQ ID NO: 15939

SEQ ID NO: 32911 - DNA, 203 bp, Homo sapiens; identical to SEQ ID NO: 15941

SEQ ID NO: 32912 - DNA, 203 bp, Homo sapiens; identical to SEQ ID NO: 15942

SEQ ID NO: 32913 - DNA, 203 bp, Homo sapiens; identical to SEQ ID NO: 15943

SEQ ID NO: 32914 - DNA, 203 bp, Homo sapiens; identical to SEQ ID NO: 15944

SEQ ID NO: 32915 - DNA, 203 bp, Homo sapiens; identical to SEQ ID NO: 15946

SEQ ID NO: 32916 - DNA, 203 bp, Homo sapiens; identical to SEQ ID NO: 15947

SEQ ID NO: 32917 - DNA, 203 bp, Homo sapiens; identical to SEQ ID NO: 15948

SEQ ID NO: 32918 - DNA, 203 bp, Homo sapiens; identical to SEQ ID NO: 15950

SEQ ID NO: 32919 - DNA, 203 bp, Homo sapiens; identical to SEQ ID NO: 15954

SEQ ID NO: 32920 - DNA, 203 bp, Homo sapiens; identical to SEQ ID NO: 15955

SEQ ID NO: 32921 - DNA, 203 bp, Homo sapiens; identical to SEQ ID NO: 15958

SEQ ID NO: 32922 - DNA, 203 bp, Homo sapiens; identical to SEQ ID NO: 15959

SEQ ID NO: 32923 - DNA, 203 bp, Homo sapiens; identical to SEQ ID NO: 15960

SEQ ID NO: 32924 - DNA, 203 bp, Homo sapiens; identical to SEQ ID NO: 15961

SEQ ID NO: 32925 - DNA, 203 bp, Homo sapiens; identical to SEQ ID NO: 15962

SEQ ID NO: 32926 - DNA, 203 bp, Homo sapiens; identical to SEQ ID NO: 15963

SEQ ID NO: 32927 - DNA, 203 bp, Homo sapiens; identical to SEQ ID NO: 15967

SEQ ID NO: 32928 - DNA, 203 bp, Homo sapiens; identical to SEQ ID NO: 15968

SEQ ID NO: 32929 - DNA, 203 bp, Homo sapiens; identical to SEQ ID NO: 15973

SEQ ID NO: 32930 - DNA, 203 bp, Homo sapiens; identical to SEQ ID NO: 15975

SEQ ID NO: 32931 - DNA, 203 bp, Homo sapiens; identical to SEQ ID NO: 15976

SEQ ID NO: 32932 - DNA, 203 bp, Homo sapiens; identical to SEQ ID NO: 15977

SEQ ID NO: 32933 - DNA, 203 bp, Homo sapiens; identical to SEQ ID NO: 15979

SEQ ID NO: 32934 - DNA, 203 bp, Homo sapiens; identical to SEQ ID NO: 15985

SEQ ID NO: 32935 - DNA, 203 bp, Homo sapiens; identical to SEQ ID NO: 15994

SEQ ID NO: 32936 - DNA, 203 bp, Homo sapiens; identical to SEQ ID NO: 15995

SEQ ID NO: 32937 - DNA, 203 bp, Homo sapiens; identical to SEQ ID NO: 15998

SEQ ID NO: 32938 - DNA, 203 bp, Homo sapiens; identical to SEQ ID NO: 15999

SEQ ID NO: 32939 - DNA, 203 bp, Homo sapiens; identical to SEQ ID NO: 16000

SEQ ID NO: 32940 - DNA, 203 bp, Homo sapiens; identical to SEQ ID NO: 16010

SEQ ID NO: 32941 - DNA, 203 bp, Homo sapiens; identical to SEQ ID NO: 16012

SEQ ID NO: 32942 - DNA, 203 bp, Homo sapiens; identical to SEQ ID NO: 16013

SEQ ID NO: 32943 - DNA, 203 bp, Homo sapiens; identical to SEQ ID NO: 17158

SEQ ID NO: 32944 - DNA, 203 bp, Homo sapiens; identical to SEQ ID NO: 17186

SEQ ID NO: 32945 - DNA, 203 bp, Homo sapiens; identical to SEQ ID NO: 17189

SEQ ID NO: 32946 - DNA, 203 bp, Homo sapiens; identical to SEQ ID NO: 17192

SEQ ID NO: 32947 - DNA, 203 bp, Homo sapiens; identical to SEQ ID NO: 17193

SEQ ID NO: 32948 - DNA, 203 bp, Homo sapiens; identical to SEQ ID NO: 17194

SEQ ID NO: 32949 - DNA, 203 bp, Homo sapiens; identical to SEQ ID NO: 17195

SEQ ID NO: 32950 - DNA, 203 bp, Homo sapiens; identical to SEQ ID NO: 17196

SEQ ID NO: 32951 - DNA, 203 bp, Homo sapiens; identical to SEQ ID NO: 17197

SEQ ID NO: 32952 - DNA, 203 bp, Homo sapiens; identical to SEQ ID NO: 17198

SEQ ID NO: 32953 - DNA, 203 bp, Homo sapiens; identical to SEQ ID NO: 17200

SEQ ID NO: 32954 - protein, 553 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAMQASPETKQTIWQLATEPTGPLVQRITKNILVVKCKASQKHSLGYLHTSFVQKVSGKSLPERRFFCSCQTLKSHKSNASKDETAQRCIHFFACICAFASDETLAQEFSDFLNFDSSGLKEIIVPQLGCHSESTVSACESTASKSKKRRKDEVSGAQMNSSLLPQDAVSSNLRKSGLKKPVVASSLKRQACGQLLDEAQVTLSFQDWLASVTERIHQTMHYQFDGKPEPLVFHIPQSFFDALQQRISIGSAKKRLPNSTTAFVRKDALPLGTFSKYTWHITNILQVKQILDTPEMPLEITRSFIQNRDGTYELFKCPKVEVESIAETYGRIEKQPVLRPLELKTFLKVDYQDLHLGKWESYLRNIGQKLCHWLVEKEEAECLHCYTIQLKLQKILG

SEQ ID NO: 32955 - protein, 15 aa, Homo sapiens
AVIISLQMIVFSPDH

SEQ ID NO: 32956 - protein, 24 aa, Homo sapiens
IQVTLFSRCLGSWYRASEKWNQIL

SEQ ID NO: 32957 - protein, 623 aa, Homo sapiens
MEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYED

SEQ ID NO: 32958 - protein, 20 aa, Homo sapiens
ASCCGRMPRLGTPQRCVGST

SEQ ID NO: 32959 - protein, 67 aa, Homo sapiens
GFGGSCWASATGPSPSQAVLVPIATASSAVAALLLTAWRTLRMILGPWGPVGTVVLSAEAPTSCRRR

SEQ ID NO: 32960 - protein, 29 aa, Homo sapiens
IPIAVITAITTATSIFLQIPPLLPRDFLL

SEQ ID NO: 32961 - protein, 440 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGNLTET

SEQ ID NO: 32962 - protein, 466 aa, Homo sapiens
AERKLSEKSLVVAAVAPDNRNPAFTTMGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGNLTET

SEQ ID NO: 32963 - protein, 140 aa, Homo sapiens
MPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGTDRTEDSGLAAGPPEAAGENFAPCSVAPGKSL

SEQ ID NO: 32964 - protein, 46 aa, Homo sapiens
TVGSTTSPHRCPHPARAAPALAQTQGRNRWTPGSLPGSRRNPPAGG

SEQ ID NO: 32965 - protein, 151 aa, Homo sapiens
VWPEGQALGPGMPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGTDRTEDSGLAAGPPEAAGENFAPCSVAPGKSL

SEQ ID NO: 32966 - protein, 22 aa, Homo sapiens
VRIKSEENLHSTDSTDILECIQ

SEQ ID NO: 32967 - protein, 147 aa, Homo sapiens
MRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKRAVGSPSLPLFCHPKSSVLRVMQWDSTLVRTSSYPRSSPASVIS

SEQ ID NO: 32968 - protein, 28 aa, Homo sapiens
MNSQPQTRSPVSKQKLEPNYILYLCLCV

SEQ ID NO: 32969 - protein, 9 aa, Homo sapiens
IHNLKPVLR

SEQ ID NO: 32970 - protein, 14 aa, Homo sapiens
IHNLKPVLRNPTEY

SEQ ID NO: 32971 - protein, 385 aa, Homo sapiens
MNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSP

SEQ ID NO: 32972 - protein, 133 aa, Homo sapiens
IHNLKPVLRLQRGLDLPIIRIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFAAGPRPPHHQNS

SEQ ID NO: 32973 - protein, 12 aa, Homo sapiens
IHNLKPVLRDTY

SEQ ID NO: 32974 - protein, 355 aa, Homo sapiens
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGIWLRCN

SEQ ID NO: 32975 - protein, 20 aa, Homo sapiens
GRLLEVVSAHGILGPQVYLR

SEQ ID NO: 32976 - protein, 392 aa, Homo sapiens
LSPLDFSAFGLSCFHFLLLTPVWPSWEPVLAAAVSGVMWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGIWLRCN

SEQ ID NO: 32977 - protein, 11 aa, Homo sapiens
GRRCIYGNCRH

SEQ ID NO: 32978 - protein, 14 aa, Homo sapiens
ISAPLDSPVFTFFC

SEQ ID NO: 32979 - protein, 58 aa, Homo sapiens
MTVVTMASARVQDLIGLICWQYTSEGREPKLNSKIRTTPKRETKPDQMQKYSVERKKF

SEQ ID NO: 32980 - protein, 116 aa, Homo sapiens
ISGKQSILSVRLEQCPLQLNNPFNEYSKFDGKGHVGTTATKKIDVYLPLHSSQDRLLPMTVVTMASARVQDLIGLICWQYTSEGREPKLNSKIRTTPKRETKPDQMQKYSVERKKF

SEQ ID NO: 32981 - protein, 15 aa, Homo sapiens
ITLLTSIPNLMARVM

SEQ ID NO: 32982 - protein, 249 aa, Homo sapiens
QEMDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKNIQPKVEEKISFSDDFSKNGSATSKVLLLPPDVSALATQAEIESIVKPKVLVKEAEKKLPSDTEKEDRSPSAIFSAELSKTSGNPIYMQFCAFMPLLDLGNIPLHFVFYIMFIVSHMSHW

SEQ ID NO: 32983 - protein, 94 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGCVAGTVLV

SEQ ID NO: 32984 - protein, 39 aa, Homo sapiens
VCSWDGAGLSWTLSDGFLQPSSTACHRRSAGSRSPRPLL

SEQ ID NO: 32985 - protein, 9 aa, Homo sapiens
GRGRPRRGV

SEQ ID NO: 32986 - protein, 11 aa, Homo sapiens
LGRCWSELDLV

SEQ ID NO: 32987 - protein, 36 aa, Homo sapiens
MGMQRTQPSPGPGTPAGSGRVPVALTGSLSPPWKRM

SEQ ID NO: 32988 - protein, 764 aa, Homo sapiens
AGPCLMASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLRV

SEQ ID NO: 32989 - protein, 66 aa, Homo sapiens
MLDGNSGLSSEKISHNPWSLRCHKQQLSRMRSESKDRKLYSILVAPPSGVSTGSIGRVLGHHSAYG

SEQ ID NO: 32990 - protein, 18 aa, Homo sapiens
MESKRLRLLQEEDRRKKV

SEQ ID NO: 32991 - protein, 91 aa, Homo sapiens
QLQPPDEREHPAEGDGEQETAAAPGRRQTEKGLTPGQHSPLTIPATVMTSLRQPRLAQLGPPLCQSYLGFTLTLKRNATSACSLDITTATP

SEQ ID NO: 32992 - protein, 8 aa, Homo sapiens
MMPLSSMS

SEQ ID NO: 32993 - protein, 76 aa, Homo sapiens
RTTGEAASPLTVCPPDGTQTRIPRMPMTQAVSHLRGASRTVPLTPTPSASMPVPGRPPRLPRSSATSPMETTATLP

SEQ ID NO: 32994 - protein, 50 aa, Homo sapiens
LHSASAKRGAQSRYQIPVHRGSGRGRLAKQRPLSQYVLPTGHRLGYPGCQ

SEQ ID NO: 32995 - protein, 165 aa, Homo sapiens
MSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEGCVRHCVISQALSRPLFSTNRPGSRKPVEFSLFHR

SEQ ID NO: 32996 - protein, 104 aa, Homo sapiens
AIHGLFSCTSPPFCYQESQSGCFQGLSSVMALGLKCFRMVHPTFRNYLAASIRPVSEVTLKTVHERQHGHRQYMAYSAVPVRHFATKKAKVDVSKDCLQSWPWD

SEQ ID NO: 32997 - protein, 27 aa, Homo sapiens
KKHVQSQRLSIASSSPTHLQATSSRSV

SEQ ID NO: 32998 - protein, 8 aa, Homo sapiens
AEEMNEMK

SEQ ID NO: 32999 - protein, 1039 aa, Homo sapiens
MDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTE

SEQ ID NO: 33000 - protein, 14 aa, Homo sapiens
ALSPGSRLQWILKK

SEQ ID NO: 33001 - protein, 13 aa, Homo sapiens
IKYLEYKEIRKVD

SEQ ID NO: 33002 - protein, 42 aa, Homo sapiens
LKMGRKKIQITRIMDERNRQELHFVKKEQEFSARIISKCTFC

SEQ ID NO: 33003 - protein, 297 aa, Homo sapiens
MDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLELHFVKKEQEFSARIISKCTFC

SEQ ID NO: 33004 - protein, 16 aa, Homo sapiens
LPRKAKVEQLDLWLST

SEQ ID NO: 33005 - protein, 12 aa, Homo sapiens
MKNLALSIVKKN

SEQ ID NO: 33006 - protein, 25 aa, Homo sapiens
VTAKEGKGRATGSLALHIASDLRPY

SEQ ID NO: 33007 - protein, 247 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQS

SEQ ID NO: 33008 - protein, 113 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKVGLSKSDPK

SEQ ID NO: 33009 - protein, 22 aa, Homo sapiens
AAIPAGQMERGAREMAAPGDCA

SEQ ID NO: 33010 - protein, 56 aa, Homo sapiens
LQSLLGRWREEQGRWQPRGTVHREGLMKWQLSPVQWPPVSQGPETRKGRKAASLPL

SEQ ID NO: 33011 - protein, 52 aa, Homo sapiens
ALSSGHPSAKGQRPGKEERQLHFLFEDGVAQPRWKEQKICKISVHLQVPDAL

SEQ ID NO: 33012 - protein, 11 aa, Homo sapiens
MLVYHRKLLKN

SEQ ID NO: 33013 - protein, 49 aa, Homo sapiens
MEDHLQIPFIQVSSLLLALRYLWERSQEIYLRMNLFHYLRKLDLYGIFV

SEQ ID NO: 33014 - protein, 10 aa, Homo sapiens
GTLGKNRLHT

SEQ ID NO: 33015 - protein, 62 aa, Homo sapiens
MGERKGVNKYYPPDFNPEKHGSLNRYHNSHPLRERARKLSQGILIIRHAAFWMPPMPGGSLV

SEQ ID NO: 33016 - protein, 53 aa, Homo sapiens
AWRESCLSWHHHTAHDIFAGKPVDPLPGSTRGQDSAVCSQGQFLIVRPEAEDQ

SEQ ID NO: 33017 - protein, 66 aa, Homo sapiens
AAPKMGERKGVNKYYPPDFNPEKHGSLNRYHNSHPLRERARKLSQGILIIRHAAFWMPPMPGGSLV

SEQ ID NO: 33018 - protein, 36 aa, Homo sapiens
AGTTTRPTTSSQGSLWTLCQAPQEVRTVQCVHKASF

SEQ ID NO: 33019 - protein, 49 aa, Homo sapiens
LAGVLSELAPPHGPRHLRREACGPSARLHKRSGQCSVFTRPVSDRPPRG

SEQ ID NO: 33020 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 33021 - protein, 27 aa, Homo sapiens
GLQTWTVSHCQASRAPTCRRPVVGQSL

SEQ ID NO: 33022 - protein, 1671 aa, Homo sapiens
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIK

SEQ ID NO: 33023 - protein, 1729 aa, Homo sapiens
AGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIK

SEQ ID NO: 33024 - protein, 168 aa, Homo sapiens
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEERT

SEQ ID NO: 33025 - protein, 33 aa, Homo sapiens
LLSLTSTLDHMVTCLMEMPFLKLRFAELHYFYT

SEQ ID NO: 33026 - protein, 220 aa, Homo sapiens
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHRRLMQMICIRGRILTRSSVP

SEQ ID NO: 33027 - protein, 74 aa, Homo sapiens [sequence omitted]

SEQ ID NO: 33028 - protein, 54 aa, Homo sapiens
IATQDDERLRWRRLPQPLPPRSKKPKVGSWRPLASPTRVKRPLLWWWLQRQQQR

SEQ ID NO: 33029 - protein, 13 aa, Homo sapiens
LPKEVTGFHPETT

SEQ ID NO: 33030 - protein, 8 aa, Homo sapiens
LPPRTMSG

SEQ ID NO: 33031 - protein, 309 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKGLTLESPPHHAPRWKKQKGTRCCKLWQMPRARGVE

SEQ ID NO: 33032 - protein, 251 aa, Homo sapiens [sequence omitted]

SEQ ID NO: 33033 - protein, 32 aa, Homo sapiens
LSLQPDPGSWKNHVRQLLVMPGTHCCPRGAAV

SEQ ID NO: 33034 - protein, 276 aa, Homo sapiens
IICECWEEECQSCRLKITQPREICRMDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQVFCL

SEQ ID NO: 33035 - protein, 49 aa, Homo sapiens
MLGRGMPELPAENYPTKRNLQDGLSGPLLVLPGFGADGSCSYLRLLENP

SEQ ID NO: 33036 - protein, 51 aa, Homo sapiens
MYTLESGLIGKKLLAQWQNENKKILRTKKEDYRPVPPMNIDAKILNKILVN

SEQ ID NO: 33037 - protein, 77 aa, Homo sapiens
METESESSTLGDDSVFWLESEVIIQVTDCEEEEREEKFRKMKSSVHSEEDDFVPELHRNVHPRERPDWEETLSAMAK

SEQ ID NO: 33038 - protein, 14 aa, Homo sapiens
LTVKRKKGKRSSGR

SEQ ID NO: 33039 - protein, 11 aa, Homo sapiens
MQLCVPLRPRN

SEQ ID NO: 33040 - protein, 8 aa, Homo sapiens
APPPRRRP

SEQ ID NO: 33041 - protein, 20 aa, Homo sapiens
ALPWPLCSVRTRRTSRVSWL

SEQ ID NO: 33042 - protein, 24 aa, Homo sapiens
MRSPGTHRACWRPLTPTASRRSGP

SEQ ID NO: 33043 - protein, 45 aa, Homo sapiens
AVGSCVAGPGAAGGAAAASEALGLGPVPYRLERVHPAAHPQPAHG

SEQ ID NO: 33044 - protein, 199 aa, Homo sapiens
LLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEK

SEQ ID NO: 33045 - protein, 33 aa, Homo sapiens
GTGAGACALSAGTSSSCSPSTTCSWVTPRSSAS

SEQ ID NO: 33046 - protein, 529 aa, Homo sapiens [sequence omitted]

SEQ ID NO: 33047 - protein, 563 aa, Homo sapiens
AWLSAWTQRFRLPGFLVVFRISGKSVQAFSVGAGMDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYK

SEQ ID NO: 33048 - protein, 117 aa, Homo sapiens
QQCCCEPGCLLGPRGFVCQGFWLYLGFQGKVSKLSVLEQVWTTKATRAMRRHLRPSNPPAKSSGKHGVFEGPLSPSERAQGTRRLTHWSRHPHSSSWACPCGAVGGSPSALSAWSSS

SEQ ID NO: 33049 - protein, 288 aa, Homo sapiens
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEATTTRIFLVSFQISITLKTRV

SEQ ID NO: 33050 - protein, 70 aa, Homo sapiens
MMRQAPTARKTTTRRPKPTRPASTGVAGASSSLGPSGSASAGDWKRPPRHCGLCWSHTVCHWQMGRRDSG

SEQ ID NO: 33051 - protein, 445 aa, Homo sapiens
MSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKGSWPLEEVVLLVSISSSVQEGEKYPHPCAARHRTPSLRSPDQPPPCPQFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRTPCWRTWSLPPPTSPNGLCSCRRRPPTHTQLETTHTRRLPCHPPSPHPRPARPSMAQSLTP

SEQ ID NO: 33052 - protein, 17 aa, Homo sapiens
ARPWAATFLNSTACCWN

SEQ ID NO: 33053 - protein, 15 aa, Homo sapiens
AFTHRNEHVPGQQPF

SEQ ID NO: 33054 - protein, 83 aa, Homo sapiens
METVTCSWRESTCTTMRLLVTNMYLGPSWWIWSLAPWTLSGLDPSARSSDQTTSCSARAEPGITGPRATTQREPSWSTRSWMW

SEQ ID NO: 33055 - protein, 13 aa, Homo sapiens
AWDRPHRQLPWRQ

SEQ ID NO: 33056 - protein, 260 aa, Homo sapiens
GRSLRSPARRSTPRTAPRASATRSAAGTMREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNSFSVMPSPKVSDTVVEPYNATLSVHQLVENTDETYCIDNEALYDICFRTLKLTTPTYGTSTTWCRPP

SEQ ID NO: 33057 - protein, 22 aa, Homo sapiens
MQKPAAMVTLITHLVQHLTGRA

SEQ ID NO: 33058 - protein, 79 aa, Homo sapiens
MQKPAAMEKMSTLVLVMGSQKILGPFLKWKRSSSVQLKVVTGHLYGQLTLNTTSRLIEMTAPSSVLQKVVGKASMCCRG

SEQ ID NO: 33059 - protein, 89 aa, Homo sapiens
LLLLVHNWQRMQKPAAMEKMSTLVLVMGSQKILGPFLKWKRSSSVQLKVVTGHLYGQLTLNTTSRLIAPGTVCSEYVHPIGTGACRIRS

SEQ ID NO: 33060 - protein, 637 aa, Homo sapiens
MQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQENIL

SEQ ID NO: 33061 - protein, 27 aa, Homo sapiens
ACSRCCGQQYHQHQRPCRGLQDLHAGA

SEQ ID NO: 33062 - protein, 197 aa, Homo sapiens
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKAYQQSDGAEDNRDGRCSKLGKGHQSQEVSSDFEPAEQVALPALILSSCFLERRIERALKMRLKYLHHYSKGEILDLSFDCSFFLPPHLFFLFR

SEQ ID NO: 33063 - protein, 14 aa, Homo sapiens
MTDPHYKDTPLAPV

SEQ ID NO: 33064 - protein, 14 aa, Homo sapiens
ASLVRVFHHASTAP

SEQ ID NO: 33065 - protein, 55 aa, Homo sapiens
MIPAMAWIHRKQGLGFHLTSEMMRKLQAWRQNQREVREKKQGHLSLLKSCFHCLL

SEQ ID NO: 33066 - protein, 498 aa, Homo sapiens
MENVDNSLDGSDVSEPAKPEAGLEVAQSILSKFSMKSLFGFTSKLESVNPEEEDAVLKAFHSLDVNPTSQQDDSSNGLDPQEAGSRVSPDLGNDEKIASVETESEGSQRKEAGTSLLAQELLPLSTLKGTKDDVICVRGTLVHTTSDSDSDDGGQEPEEGSSTNGPKSPSGVLSEPSQESKENPGGFRENTVTGEMNGAELCAEDPQRIPPEMSSKLEAGNGGLQTERRPSQDQVGEEGSQDLPAVTNQNSSVGITESASSKKEVSGEKSFQLPAFFSGLRVLKKGATAEGGETITEIKPKDGDLALLKLTQPVQKSLVQAGLQTVKSEKKATDPKATPTLLEQLSLLLNIDMPKTEPKGADPESPRREEMGCNADQESQSGPGVPQTQGGEVKPKSPETALEAFKALFIRPPRKGTTADTSELEALKRKMRHEKESLRAVFERSNSKPADGPSDSKSPDHSLTEQDDRTPGRLQAVWPPPKTKDTEEKVGLKYTEAG

SEQ ID NO: 33067 - protein, 8 aa, Homo sapiens
IQKRKMLC

SEQ ID NO: 33068 - protein, 17 aa, Homo sapiens
IRICESRRGRCCAESIP

SEQ ID NO: 33069 - protein, 306 aa, Homo sapiens
MGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33070 - protein, 30 aa, Homo sapiens
RFLRLHPHWLSLLNQTPSSEDFWLIFQKAQ

SEQ ID NO: 33071 - protein, 26 aa, Homo sapiens
AMRSSQICPKQFHSQWDCIWERQKQK

SEQ ID NO: 33072 - protein, 298 aa, Homo sapiens
MGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33073 - protein, 356 aa, Homo sapiens
KVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33074 - protein, 80 aa, Homo sapiens
MSAISVHGVSTSGGQMYHYDMNTASLSQQQDQKPIFNVIPPIPVGSENWNRCQGSGDDNLTSLGTLNFPGRTVFSNGYSS

SEQ ID NO: 33075 - protein, 138 aa, Homo sapiens
KDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33076 - protein, 13 aa, Homo sapiens
RIMEIWFCQAPVM

SEQ ID NO: 33077 - protein, 12 aa, Homo sapiens
LVIKCLPFLFMV

SEQ ID NO: 33078 - protein, 20 aa, Homo sapiens
ARETGHSLLSGKLSWSKYNW

SEQ ID NO: 33079 - protein, 60 aa, Homo sapiens
MNTASLSQQQDQKPIFNVIPPIPVGSENWNRCQGSGDDNLTSLGTLNFPGRTVFSNGYSS

SEQ ID NO: 33080 - protein, 38 aa, Homo sapiens
IQHPFLNSRIRSLFLMSFHQFPLVPKIGIGAKDLEMTT

SEQ ID NO: 33081 - protein, 85 aa, Homo sapiens
AAIQKSLKDPSNNFRLHNGRSKEQRLKEQLGAQQEPVKKSIQESEAFLPQSIPEERYKMKSKPLGICLIIDCIGNETELPHWKGF

SEQ ID NO: 33082 - protein, 10 aa, Homo sapiens
MTMKHGQKMT

SEQ ID NO: 33083 - protein, 471 aa, Homo sapiens
IMGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGI

SEQ ID NO: 33084 - protein, 107 aa, Homo sapiens
MENCLGESRHEVEKSEISENTDASGKIEKYNVPLNRLKMMFEKGEPTQTKILRAQSRSASGRKISENSYSLDDLEIGPGTRKQLKKQTWRRREVTPKISPSTLERGP

SEQ ID NO: 33085 - protein, 56 aa, Homo sapiens
QATLLLEPKLTKKNKSTPDLDSGHLLKPSFRVDIPTSRTVRILKTTQQKVKKWKIV

SEQ ID NO: 33086 - protein, 9 aa, Homo sapiens
AQWKRILTQ

SEQ ID NO: 33087 - protein, 17 aa, Homo sapiens
LIHPLSRFEYEHSGRGF

SEQ ID NO: 33088 - protein, 133 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLVCFFSRIK

SEQ ID NO: 33089 - protein, 787 aa, Homo sapiens
MYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSS

SEQ ID NO: 33090 - protein, 109 aa, Homo sapiens
AKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGR

SEQ ID NO: 33091 - protein, 130 aa, Homo sapiens
QTGETEPWRVSEDFVSYSISRRVPGCSGSDDPSVHEPGLHQLPCVQPPQLHSNHVPLSPAFPQTWQVTNITTPAVHDAADATRCSQKERKCIFKAPPFGIPTVSNLRRPRKSCGCQTFGVLHPISFIPKV

SEQ ID NO: 33092 - protein, 109 aa, Homo sapiens
RGLLHKERRVSLHPGLPADVRDTLPWLWGVRGGRSGDCSGQDLPSQLLCLYYLQAPVSTRRPSHIQWERLPLSTLCTADVVQSERNHLLQHGPPSGPSPPIREACHSLP

SEQ ID NO: 33093 - protein, 83 aa, Homo sapiens
MGETAFVNSVHSRCRPVRKKPPSPAIVPAAEEISRMGRRCWRWISSGTWGALNASPAGRSSPGSTSARMVLRTVKRTTRDSLG

SEQ ID NO: 33094 - protein, 112 aa, Homo sapiens
LLWARPTIPIALLVLSASARFHPETESHSMGETAFVNSVHSRCRPVRKKPPSPAIVPAAEEISRMGRRCWRWISSGTWGALNASPAGRSSPGSTSARMVLRTVKRTTRDSLG

SEQ ID NO: 33095 - protein, 10 aa, Homo sapiens
AHQVILSMQK

SEQ ID NO: 33096 - protein, 3081 aa, Homo sapiens
MEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTK

SEQ ID NO: 33097 - protein, 10 aa, Homo sapiens
AERRAAAQVD

SEQ ID NO: 33098 - protein, 2961 aa, Homo sapiens
MAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTK

SEQ ID NO: 33099 - protein, 112 aa, Homo sapiens
MTTASLTLRWKWPMRANTMPTATSSACVATTPSVPGHRAGPGMPGAAGQWPQAMGACGKTPWGPGASACLVPLGCPPSSPRTSSPSTACSRACEVGAPSRAAPALVSGLAMA

SEQ ID NO: 33100 - protein, 9 aa, Homo sapiens
IWCRIWRQT

SEQ ID NO: 33101 - protein, 121 aa, Homo sapiens
VSATCTGQAMTTASLTLRWKWPMRANTMPTATSSACVATTPSVPGHRAGPGMPGAAGQWPQAMGACGKTPWGPGASACLVPLGCPPSSPRTSSPSTACSRACEVGAPSRAAPALVSGLAMA

SEQ ID NO: 33102 - protein, 407 aa, Homo sapiens
MWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIHQIYRDQDLTQEIAMEHFVKKVEAAHCAACDLFIPMQFGIIQKHLKTMDHNRNRRALSRDLKPLCSRHTRIPALSPPVIMDMELGTLGQIEATRAMAMAMAMARITPPTMGMVWPLHTLGKCLALTQMQTLVPRVAPVPIPFYPELTSA

SEQ ID NO: 33103 - protein, 84 aa, Homo sapiens
VGRPHGGPGPVHVWCLSAALPLLPEHHPRVRHVPGHARWGRLPGRLPLWFRVWQWHEADEADLEDLDHSRLPNQEEEEKAGRQS

SEQ ID NO: 33104 - protein, 12 aa, Homo sapiens
RLWEVCISCRSC

SEQ ID NO: 33105 - protein, 10 aa, Homo sapiens
LQKLLEIIPF

SEQ ID NO: 33106 - protein, 21 aa, Homo sapiens
KVVSQGECIGFQLGNKTNLGF

SEQ ID NO: 33107 - protein, 592 aa, Homo sapiens
MLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIF

SEQ ID NO: 33108 - protein, 666 aa, Homo sapiens
GCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIF

SEQ ID NO: 33109 - protein, 15 aa, Homo sapiens
LLCSIAFITKVFVVG

SEQ ID NO: 33110 - protein, 24 aa, Homo sapiens
MNIRRQCSPKIRILYHLLINTGSA

SEQ ID NO: 33111 - protein, 8 aa, Homo sapiens
IPHPVYLS

SEQ ID NO: 33112 - protein, 10 aa, Homo sapiens
RKCALVLWPT

SEQ ID NO: 33113 - protein, 10 aa, Homo sapiens
QPKTEQCCVY

SEQ ID NO: 33114 - protein, 41 aa, Homo sapiens
MEGPQGPPRRPGVTLCFLLSAFPLMATHWNTRLTKMAIGIF

SEQ ID NO: 33115 - protein, 61 aa, Homo sapiens
MGELQQEAAEKDEEPSANSRMEGPQGPPRRPGVTLCFLLSAFPLMATHWNTRLTKMAIGIF

SEQ ID NO: 33116 - protein, 37 aa, Homo sapiens
LSLIRTPLTPRSWNLTAGQENLFLETSTEPACMNGFC

SEQ ID NO: 33117 - protein, 20 aa, Homo sapiens
RSQAQTAGWRDHRDHQEGPE

SEQ ID NO: 33118 - protein, 9 aa, Homo sapiens
QRWLSVYSS

SEQ ID NO: 33119 - protein, 962 aa, Homo sapiens
MCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQ

SEQ ID NO: 33120 - protein, 15 aa, Homo sapiens
RRAPWMKRMADSWVR

SEQ ID NO: 33121 - protein, 46 aa, Homo sapiens
RNTQIQAVKIQKKITPNLDFWIRTLVTLVLLMTTKNRAVLCLLVGI

SEQ ID NO: 33122 - protein, 96 aa, Homo sapiens
MDIIPFIDKYWECMTTRQRPGKMTWPNNIVKTMSKERDVFLVKEHPDPGSKDPEEDYPKFGLLDQDLSNIGPAYDNQKQSSAVSTSGNLNGYYTIY

SEQ ID NO: 33123 - protein, 37 aa, Homo sapiens
MILSTFHDQLQFSLQRLPSQWEYLFPPEASKLEGNVP

SEQ ID NO: 33124 - protein, 8 aa, Homo sapiens
VTWAGAPW

SEQ ID NO: 33125 - protein, 37 aa, Homo sapiens
MGTLTRGNCSRKQRKRTRSQAQTAGWRDHRDHQEGPE

SEQ ID NO: 33126 - protein, 24 aa, Homo sapiens
MHLKMELKSLLISRKTLMKNVYMK

SEQ ID NO: 33127 - protein, 32 aa, Homo sapiens
KHLGSQHQMHLKMELKSLLISRKTLMKNVYMK

SEQ ID NO: 33128 - protein, 13 aa, Homo sapiens
MCNKRMMGVVCGI

SEQ ID NO: 33129 - protein, 24 aa, Homo sapiens
MKAVKIHLKNLRIVMFNVKQSVTS

SEQ ID NO: 33130 - protein, 18 aa, Homo sapiens
QKKQLFWDKARFFQRFWN

SEQ ID NO: 33131 - protein, 13 aa, Homo sapiens
RLMSAIKKPKGNS

SEQ ID NO: 33132 - protein, 37 aa, Homo sapiens
KQKILSQKERNQMSIQKIWRRPIGSQKNLAKETTLLG

SEQ ID NO: 33133 - protein, 25 aa, Homo sapiens
ILPKILELKTCFGQKSINLRLPVNL

SEQ ID NO: 33134 - protein, 18 aa, Homo sapiens
QKKQLFWDKARFFQRILL

SEQ ID NO: 33135 - protein, 329 aa, Homo sapiens
ILPKDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKGFCYNNRFKSYCFKASREKSEETSVFE

SEQ ID NO: 33136 - protein, 172 aa, Homo sapiens
MLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPIKIHLKNLRIVMFNVKQSVTS

SEQ ID NO: 33137 - protein, 42 aa, Homo sapiens
MLWTEKYQPQTASELIGNELAIKKLHRVLFVAFETTLLSSLN

SEQ ID NO: 33138 - protein, 24 aa, Homo sapiens
LQILVISEKVSFTYNSGLEVEVEF

SEQ ID NO: 33139 - protein, 11 aa, Homo sapiens
MWYQPLQRIAQ

SEQ ID NO: 33140 - protein, 181 aa, Homo sapiens
AQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMRPDGFAVSAYCGTTSSTWSSALCSASPCCCWGSHTAP

SEQ ID NO: 33141 - protein, 299 aa, Homo sapiens
MIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRILLSLLNSVISQTLMSCNWKQQMRRMKTILIILILIWI

SEQ ID NO: 33142 - protein, 356 aa, Homo sapiens
MIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININDCCAKETATYDKKSRIRLSVSQEEERIYARVRGEIKGCPLRKRATEERKWNTEAAAG

SEQ ID NO: 33143 - protein, 241 aa, Homo sapiens
MNQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININEPEA

SEQ ID NO: 33144 - protein, 12 aa, Homo sapiens
MHVGTGFQENEP

SEQ ID NO: 33145 - protein, 232 aa, Homo sapiens
QDHKTKNVNCVTSNKHKCMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININACWNRIPGE

SEQ ID NO: 33146 - protein, 184 aa, Homo sapiens
MQRMKKTPDNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSR

SEQ ID NO: 33147 - protein, 17 aa, Homo sapiens
RMNMMPCRSLLLPWREN

SEQ ID NO: 33148 - protein, 8 aa, Homo sapiens
KSQPDPEG

SEQ ID NO: 33149 - protein, 786 aa, Homo sapiens
LRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDS

SEQ ID NO: 33150 - protein, 11 aa, Homo sapiens
MAGMSWTLWWC

SEQ ID NO: 33151 - protein, 21 aa, Homo sapiens
IYDFSHHHSELHRPRTGAASA

SEQ ID NO: 33152 - protein, 12 aa, Homo sapiens
MGTWSGSQKQKR

SEQ ID NO: 33153 - protein, 24 aa, Homo sapiens
TMPQGTLGTGCTSSPSSSSAPFLC

SEQ ID NO: 33154 - protein, 22 aa, Homo sapiens
GGNNRLNVSSMGTWSGSQKQKR

SEQ ID NO: 33155 - protein, 535 aa, Homo sapiens
MDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33156 - protein, 18 aa, Homo sapiens
KKQRTRNLPYRKPRRWQK

SEQ ID NO: 33157 - protein, 54 aa, Homo sapiens
KSNRRIKSQPSPCGSSGPVRCESRTCWPAGRPCITKWTRTSAGRLPTRGTCGQT

SEQ ID NO: 33158 - protein, 61 aa, Homo sapiens
MALQPRTRGTRGGRTRSGGIGGGKRTRAPGSLCRAPTCQPPGQSSRTWAAKTHPWQRILTT

SEQ ID NO: 33159 - protein, 164 aa, Homo sapiens
TPGRAAWSNPGSGRARPSEARPGTPTGGTCTGRGAAGRAAAGPRARARTGSIDVIARTAGPGRRVRRTRRSGGRGTARAAGRPGAARARARAPTGASAGEGTGMALQPRTRGTRGGRTRSGGIGGGKRTRAPGSLCRAPTCQPPGQSSRTWAAKTHPWQRILTT

SEQ ID NO: 33160 - protein, 427 aa, Homo sapiens
AREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33161 - protein, 115 aa, Homo sapiens
MPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33162 - protein, 64 aa, Homo sapiens
GRSPRQPWPRRPAPEPSQDGKQHRPRPHAGHPCHGHQPPERRQPPDAQQPGEPIQSRPPQDPRE

SEQ ID NO: 33163 - protein, 253 aa, Homo sapiens
AAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33164 - protein, 20 aa, Homo sapiens
AKKRGREEGGGGRRPWGRRP

SEQ ID NO: 33165 - protein, 77 aa, Homo sapiens
MSSIALAAEDPVQPNAPRNNVLRYFDYVFTGVFTFEMVIKMIDLGLVLHQGAYFRDLWNILDFIVVSGALVAFAFTS

SEQ ID NO: 33166 - protein, 662 aa, Homo sapiens
MYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33167 - protein, 36 aa, Homo sapiens
AASPWPPRTLCSPTHLGTTCCDTLTTFLQASLPLRW

SEQ ID NO: 33168 - protein, 22 aa, Homo sapiens
LTWGSSCIRVPTSVTSGIFSTS

SEQ ID NO: 33169 - protein, 79 aa, Homo sapiens
IAMSSIALAAEDPVQPNAPRNNVLRYFDYVFTGVFTFEMVIKMIDLGLVLHQGAYFRDLWNILDFIVVSGALVAFAFTS

SEQ ID NO: 33170 - protein, 86 aa, Homo sapiens
MPQNKQSFQYRMWQFVVSPPFEYTIMAMIALNTIVLMMKFYGASVAYENALRVFNIVFTSLFSLECVLKVMAFGILGPQAFGGRHL

SEQ ID NO: 33171 - protein, 51 aa, Homo sapiens
MCAESHGFWDSVAIAKEKTSTRLNPSESSGCYDLLKPSSGCQSSRLCLTVW

SEQ ID NO: 33172 - protein, 51 aa, Homo sapiens
ADPTHAAEQAELPVPHVAVRGVSAFRVHDHGHDRPQHHRAYDEVLWGFCCL

SEQ ID NO: 33173 - protein, 15 aa, Homo sapiens
MCAESHGFWDSEGLH

SEQ ID NO: 33174 - protein, 540 aa, Homo sapiens
LTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGIL

SEQ ID NO: 33175 - protein, 56 aa, Homo sapiens
MCAESHGFWDSGSSSIRWTPPLRTRAPAPGTAWRCPFSTSSTLWCSPSSLSISLWP

SEQ ID NO: 33176 - protein, 565 aa, Homo sapiens
MREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33177 - protein, 439 aa, Homo sapiens
MSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33178 - protein, 574 aa, Homo sapiens
REVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33179 - protein, 25 aa, Homo sapiens
KPATGVAARLGRRGSGSSWETAGSQ

SEQ ID NO: 33180 - protein, 86 aa, Homo sapiens
KKRKWKKGTCCPTYRTSATARGRPARPSPRQRNQAQVLRKKRRRRKRRRRKGAPVKNQRRRRRKRKRRRRRPAATLRRHQSSLPKK

SEQ ID NO: 33181 - protein, 122 aa, Homo sapiens [sequence omitted]

SEQ ID NO: 33182 - protein, 226 aa, Homo sapiens
LSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33183 - protein, 20 aa, Homo sapiens
ATPASSRWVILGWRGSTDPL

SEQ ID NO: 33184 - protein, 96 aa, Homo sapiens
MNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33185 - protein, 47 aa, Homo sapiens
APSSQKDDLQRAPLQQPPQALRGSALRPGLRPHEQVPDLLPREEDQR

SEQ ID NO: 33186 - protein, 18 aa, Homo sapiens
MGRTQPGPQAWLLRLELR

SEQ ID NO: 33187 - protein, 110 aa, Homo sapiens
KRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33188 - protein, 11 aa, Homo sapiens
QHFIAPCSRGG

SEQ ID NO: 33189 - protein, 67 aa, Homo sapiens
MAENQAASWRKLKNSQEAQQRQATLVRKLQAKVLQYRSWCQELEKRLEATGVHRWLLVFSKGAVFPV

SEQ ID NO: 33190 - protein, 11 aa, Homo sapiens
AVCLKPNNKIL

SEQ ID NO: 33191 - protein, 19 aa, Homo sapiens
RSPRGSWRSRFKLSLKPRK

SEQ ID NO: 33192 - protein, 18 aa, Homo sapiens
TESGRAGAGCCSQTAGPG

SEQ ID NO: 33193 - protein, 6902 aa, Homo sapiens
MELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33194 - protein, 37 aa, Homo sapiens
LILRLRRARSTQSCRICRDSSPRIRKRNPSGKESRTP

SEQ ID NO: 33195 - protein, 35 aa, Homo sapiens
GSSICPPQASSRPVEDSTDPGCSEGSGPETGRASN

SEQ ID NO: 33196 - protein, 6724 aa, Homo sapiens
MAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33197 - protein, 14 aa, Homo sapiens
RWPKGRLCKRIWPS

SEQ ID NO: 33198 - protein, 34 aa, Homo sapiens
LKEKRRWRLCGDKSRNWRSNGKCRRLLWNCCLWT

SEQ ID NO: 33199 - protein, 53 aa, Homo sapiens
KRRGGGDSAGTNPGTGEATGNAEGCFGIAVSGPEEEEPRGRSAARTDSGAREV

SEQ ID NO: 33200 - protein, 6681 aa, Homo sapiens
MIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33201 - protein, 9 aa, Homo sapiens
ICSKNRFRS

SEQ ID NO: 33202 - protein, 25 aa, Homo sapiens
LCRGSRSESSRRIGRLRGTSWSISF

SEQ ID NO: 33203 - protein, 6750 aa, Homo sapiens
RNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33204 - protein, 6512 aa, Homo sapiens
MQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33205 - protein, 76 aa, Homo sapiens
AAEAERASDSGSREERPGADAAEGEDSGSRGSEDPADQDPGGGPGTDQAVLERARPGADHSEAADAGTGRGREGPK

SEQ ID NO: 33206 - protein, 6576 aa, Homo sapiens
LQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33207 - protein, 6366 aa, Homo sapiens
MTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33208 - protein, 13 aa, Homo sapiens
VRPASSCPSESRK

SEQ ID NO: 33209 - protein, 15 aa, Homo sapiens
RSSHFRVNWMRPREP

SEQ ID NO: 33210 - protein, 10 aa, Homo sapiens
AAPGPAQEGR

SEQ ID NO: 33211 - protein, 87 aa, Homo sapiens
GPESPSPEGPGTGGSAARTAAGPGTGGEGEGKGRRPPGSSGASPYDTEGASWRASGPQGTGTKAGGRAGSGGTAGPGPGGGAGRPKG

SEQ ID NO: 33212 - protein, 73 aa, Homo sapiens
MRWRPGPCRTAGCRPRQCSRNGTRSWKLCGQKVSPPGIRRRLPGPGLRLCRRPLARLMLPCRGKSSISSSRQN

SEQ ID NO: 33213 - protein, 15 aa, Homo sapiens
RKRQTPSRELWSKPI

SEQ ID NO: 33214 - protein, 37 aa, Homo sapiens
RSVMESFRTTRNRHEGWRKSWQWRDGGSRPWRRCWET

SEQ ID NO: 33215 - protein, 16 aa, Homo sapiens
MLPCRGKSSISSSRQN

SEQ ID NO: 33216 - protein, 19 aa, Homo sapiens
KSWQWRDGGSRPWRRCWET

SEQ ID NO: 33217 - protein, 459 aa, Homo sapiens
MSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWS

SEQ ID NO: 33218 - protein, 531 aa, Homo sapiens
LEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQ

SEQ ID NO: 33219 - protein, 49 aa, Homo sapiens
MGHGPSAHLQVCQRKSLALLGTQEPQVGGCSQEEEVNLQPWGGPQLTWE

SEQ ID NO: 33220 - protein, 12 aa, Homo sapiens
GHCPGGRDPQAG

SEQ ID NO: 33221 - protein, 11 aa, Homo sapiens
MESPRGVPCPG

SEQ ID NO: 33222 - protein, 171 aa, Homo sapiens
GKLHLLAPYGITQRGALPWLRDMYCLSSRIYFPSTSPPPSSSPSTINPEIFAFIFCCCLHLCSWVAAPHQGSLSGKNLPKIPVEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 33223 - protein, 15 aa, Homo sapiens
APRSPRSAGVPRKRK

SEQ ID NO: 33224 - protein, 33 aa, Homo sapiens
ICNPGEDPNSPGNEANCICLLPMESPRGVPCPG

SEQ ID NO: 33225 - protein, 40 aa, Homo sapiens [sequence omitted]

SEQ ID NO: 33226 - protein, 52 aa, Homo sapiens
REVIQEVDMAASRTAALNLLRVSRNLRANQQVPNPSQSSQKPKRSQPLRRNG

SEQ ID NO: 33227 - protein, 11 aa, Homo sapiens
IYIGSNRFSSS

SEQ ID NO: 33228 - protein, 9 aa, Homo sapiens
MDGTPLFRV

SEQ ID NO: 33229 - protein, 54 aa, Homo sapiens
MQGPEAETTICSFKETTCIFRRGESGTSRLSARRSKLASSFLVQRKMETGTLRR

SEQ ID NO: 33230 - protein, 66 aa, Homo sapiens
MQEQCPNLVLKSSRRLSVEREKSKILLMRMMMMTKLPKGRLVEERLKTLVTKKMMTLRLTQMISLK

SEQ ID NO: 33231 - protein, 78 aa, Homo sapiens
MQAVKTSKSTLGQTDFPAHSRKPAPSNEPEYLCKWMGLPYSECSWEDEALIGKKFQNCIDSFHSRNNSKTIPTRECKL

SEQ ID NO: 33232 - protein, 242 aa, Homo sapiens
MQATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKPLEHLLLYMRLKLMATLVVTLTLKRMKVKSSTSSSGRVGLTSTAHGRVKNPYSNRK

SEQ ID NO: 33233 - protein, 9 aa, Homo sapiens
MATRVFIRC

SEQ ID NO: 33234 - protein, 9 aa, Homo sapiens
LISSPTIGS

SEQ ID NO: 33235 - protein, 27 aa, Homo sapiens
APDYGDPSSEFPQRALVLAALYYAGEV

SEQ ID NO: 33236 - protein, 6101 aa, Homo sapiens
LKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIR

SEQ ID NO: 33237 - protein, 5967 aa, Homo sapiens
MELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIR

SEQ ID NO: 33238 - protein, 6043 aa, Homo sapiens
KGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIR

SEQ ID NO: 33239 - protein, 71 aa, Homo sapiens
VTLTLSLRGRPRDPLLLRVKRKTLMMTRSQSAEGVRGVCGRTSWRDLLMQRSEGSSRLIRSLVSLLNGWSA

SEQ ID NO: 33240 - protein, 21 aa, Homo sapiens
QEAKAQRASEECAEGPRGGIY

SEQ ID NO: 33241 - protein, 13 aa, Homo sapiens
IRSLVSLLNGWSA

SEQ ID NO: 33242 - protein, 26 aa, Homo sapiens
KKMPAREKDQGKGEVQQSRYPEFRLM

SEQ ID NO: 33243 - protein, 5537 aa, Homo sapiens
KKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWR

SEQ ID NO: 33244 - protein, 25 aa, Homo sapiens
LTKFCRWRQIKSLRGSSYRPERITC

SEQ ID NO: 33245 - protein, 8 aa, Homo sapiens
QNSAGGDR

SEQ ID NO: 33246 - protein, 19 aa, Homo sapiens
MELSFHLLGIQIIHQKREK

SEQ ID NO: 33247 - protein, 10 aa, Homo sapiens
MDFCFQVYRI

SEQ ID NO: 33248 - protein, 14 aa, Homo sapiens
IKAISGSCPYYSRK

SEQ ID NO: 33249 - protein, 27 aa, Homo sapiens
QGAQRARTAGTHPELPAENRRPDSRVP

SEQ ID NO: 33250 - protein, 23 aa, Homo sapiens
ISYTRWLIRKGLKKKRSKRRKTT

SEQ ID NO: 33251 - protein, 18 aa, Homo sapiens
LGVRNHFVQRPQAPAGTL

SEQ ID NO: 33252 - protein, 348 aa, Homo sapiens
MAHRCMDTQEITTITPTRDTSVMQAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNAGQIKEAEASGKEGKQSAQAERGAWN

SEQ ID NO: 33253 - protein, 173 aa, Homo sapiens
KLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDSVRRG

SEQ ID NO: 33254 - protein, 982 aa, Homo sapiens
MSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNE

SEQ ID NO: 33255 - protein, 928 aa, Homo sapiens
MLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNE

SEQ ID NO: 33256 - protein, 989 aa, Homo sapiens
AGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNE

SEQ ID NO: 33257 - protein, 19 aa, Homo sapiens
LVPKPTRCPWPTEGRISLF

SEQ ID NO: 33258 - protein, 30 aa, Homo sapiens
ISQTNRLSLLLRIMAMPWTTPSLLAGNHFL

SEQ ID NO: 33259 - protein, 31 aa, Homo sapiens
MSTIKQMRVPCLGRLNLKVSLWILWIQINRI

SEQ ID NO: 33260 - protein, 16 aa, Homo sapiens
MSVTNCTLKSCPWRES

SEQ ID NO: 33261 - protein, 21 aa, Homo sapiens
QTISMLPTMVRSMMSILMTME

SEQ ID NO: 33262 - protein, 33 aa, Homo sapiens
AVVHITLAAVWNLIGVLSLVSAHCVNLARRRWW

SEQ ID NO: 33263 - protein, 2609 aa, Homo sapiens
LEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGE

SEQ ID NO: 33264 - protein, 8 aa, Homo sapiens
MWYSLRMR

SEQ ID NO: 33265 - protein, 13 aa, Homo sapiens
KRRLEFLRSTQWC

SEQ ID NO: 33266 - protein, 9 aa, Homo sapiens
QNLLKGPEK

SEQ ID NO: 33267 - protein, 22 aa, Homo sapiens
RGPRSRNGRCWQRWKGYLSCHL

SEQ ID NO: 33268 - protein, 38 aa, Homo sapiens
MWWLHHISWRPDSKQPGSSSIQEWCQDHGHKPPADRQG

SEQ ID NO: 33269 - protein, 20 aa, Homo sapiens
AQTLMSVTNCTLKSCPWRES

SEQ ID NO: 33270 - protein, 14 aa, Homo sapiens
ARLWSISHWQQCGI

SEQ ID NO: 33271 - protein, 28 aa, Homo sapiens
MLPGRLQRLLPSLVHSTSNFLSKEMMSW

SEQ ID NO: 33272 - protein, 10 aa, Homo sapiens
AHTNHQPRGH

SEQ ID NO: 33273 - protein, 8 aa, Homo sapiens
IFLYSSNK

SEQ ID NO: 33274 - protein, 15 aa, Homo sapiens
GFSQMGGRPDRLSMD

SEQ ID NO: 33275 - protein, 25 aa, Homo sapiens
MYCSNNFMVPVLKDLWNWYLHTSYQ

SEQ ID NO: 33276 - protein, 8 aa, Homo sapiens
LQLEKAAH

SEQ ID NO: 33277 - protein, 56 aa, Homo sapiens
IDCSWKRQLTEAAPCFWNGASHPIQPFTRPEMYCSNNFMVPVLKDLWNWYLHTSYQ

SEQ ID NO: 33278 - protein, 18 aa, Homo sapiens
KKPGFVRCGLVDSQCTAA

SEQ ID NO: 33279 - protein, 37 aa, Homo sapiens
ASHPIQPFTRPEMYCSNNFMVPVLKDLWNWYLHTSYQ

SEQ ID NO: 33280 - protein, 10 aa, Homo sapiens
VPPCERNPDL

SEQ ID NO: 33281 - protein, 14 aa, Homo sapiens
MKQIECLIWALNPK

SEQ ID NO: 33282 - protein, 11 aa, Homo sapiens
LPLSTSIISHS

SEQ ID NO: 33283 - protein, 9 aa, Homo sapiens
LLNIVEHVA

SEQ ID NO: 33284 - protein, 32 aa, Homo sapiens
MKPISLQMSWMLLQDRISLNPLLFKLRDGQLL

SEQ ID NO: 33285 - protein, 1446 aa, Homo sapiens
MWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVF

SEQ ID NO: 33286 - protein, 17 aa, Homo sapiens
ANSNVECDLAKRSKTAC

SEQ ID NO: 33287 - protein, 15 aa, Homo sapiens
VQTTTFFRLWMCVMT

SEQ ID NO: 33288 - protein, 19 aa, Homo sapiens
TSQVLNGSVLCPNVLLDVK

SEQ ID NO: 33289 - protein, 17 aa, Homo sapiens
QWTKDDQSNSSRCSKTY

SEQ ID NO: 33290 - protein, 60 aa, Homo sapiens
QWTKDDQSNSSRCSKTSSWGKPQGKTLRNGFLHEALDEMTTPQQTTPQTKKNDMMQSSGK

SEQ ID NO: 33291 - protein, 1331 aa, Homo sapiens
IRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADE

SEQ ID NO: 33292 - protein, 11 aa, Homo sapiens
IVEMQMRLSMV

SEQ ID NO: 33293 - protein, 12 aa, Homo sapiens
IEAMKIKKKQVL

SEQ ID NO: 33294 - protein, 11 aa, Homo sapiens
GCQWCKRNEGS

SEQ ID NO: 33295 - protein, 35 aa, Homo sapiens
MLSYVCDWQKMHQTLMAQQQRVNQDRSKAPHSDAS

SEQ ID NO: 33296 - protein, 26 aa, Homo sapiens
ALDEMTTPQQTTPQTKKNDMMQSSGK

SEQ ID NO: 33297 - protein, 19 aa, Homo sapiens
ISLLLKSLTSYALSSSMWV

SEQ ID NO: 33298 - protein, 14 aa, Homo sapiens
QLRSKQLRKRKRTT

SEQ ID NO: 33299 - protein, 8 aa, Homo sapiens
APQCGCRV

SEQ ID NO: 33300 - protein, 16 aa, Homo sapiens
RGHTADCGQSPRRAKV

SEQ ID NO: 33301 - protein, 321 aa, Homo sapiens
MGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTVFHFSCPLPSPPHLLILFF

SEQ ID NO: 33302 - protein, 33 aa, Homo sapiens
VHQNTFGKEEESPTQRYGRGFGVPLSDNEDSGT

SEQ ID NO: 33303 - protein, 49 aa, Homo sapiens
VHQNTSSWGKPQGKTLRNGFLHEALDEMTTPQQTTPQTKKNDMMQSSGK

SEQ ID NO: 33304 - protein, 27 aa, Homo sapiens
QINSSMAMGDTSCLPHNRSLERWEASL

SEQ ID NO: 33305 - protein, 26 aa, Homo sapiens
MQMSFWKRRRESNSKIWERIWSASVR

SEQ ID NO: 33306 - protein, 58 aa, Homo sapiens
ASSTITRVRDSYPSCKDSRRICHLGFLRKDSLMQMSFWKRRRESNSKIWERIWSASVR

SEQ ID NO: 33307 - protein, 35 aa, Homo sapiens
MQKMLPAFGKEEESPTQRYGRGFGVPLSDNEDSGT

SEQ ID NO: 33308 - protein, 46 aa, Homo sapiens
ITRSRMVNRTFSTKQGQYAENAPSFWKRRRESNSKIWERIWSASVR

SEQ ID NO: 33309 - protein, 2956 aa, Homo sapiens
MQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQ

SEQ ID NO: 33310 - protein, 94 aa, Homo sapiens
MQAFLNVLDQCPKLEVDIPLVKSYLAQFAARAIISELVSISELAQPLESGTHFPLFLLCLQQLAKLQDREWLTELFQQSKFFDQFTQTGRDSHK

SEQ ID NO: 33311 - protein, 17 aa, Homo sapiens
ITRSRMVNRTFSTKQVL

SEQ ID NO: 33312 - protein, 2761 aa, Homo sapiens
MAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQ

SEQ ID NO: 33313 - protein, 19 aa, Homo sapiens
MLMERLFTQVSRCISQHLS

SEQ ID NO: 33314 - protein, 111 aa, Homo sapiens
MLMFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYVFPEASNTAS

SEQ ID NO: 33315 - protein, 133 aa, Homo sapiens
MLMFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYVCSGASTSPSSVFPEASNTAS

SEQ ID NO: 33316 - protein, 197 aa, Homo sapiens
MLMTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYDPLSLWTECRSNHAGIPSNPSDNEFTTSNPFSVCSGASTSPSSVFPEASNTAS

SEQ ID NO: 33317 - protein, 206 aa, Homo sapiens
MLMVTQVARQPGTPTPSPYSAHEINKGHPNLAATPPGHASSPGLSQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGNTSGKTAGNPYPIPLFST

SEQ ID NO: 33318 - protein, 180 aa, Homo sapiens
MMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQVFPEASNTAS

SEQ ID NO: 33319 - protein, 15 aa, Homo sapiens
MQVQPRWYTLKPLRQ

SEQ ID NO: 33320 - protein, 44 aa, Homo sapiens
MTDVNSHPQEKTQFLYPASHLAQKHQTLYQQMKMMMIYARNPVV

SEQ ID NO: 33321 - protein, 11 aa, Homo sapiens
MEETKRSDPNH

SEQ ID NO: 33322 - protein, 28 aa, Homo sapiens
QDQPTQIANANSGSSNFASRTRLYTSLC

SEQ ID NO: 33323 - protein, 17 aa, Homo sapiens
MDCQFWNRAKPQLALHW

SEQ ID NO: 33324 - protein, 77 aa, Homo sapiens
MTGSFCWTSSSCLPVYKNQRACLLSVMWFLTRSTNPNCQCELWILEFCLEDQTLHQPLLILEGRHLVEEAYLILEAY

SEQ ID NO: 33325 - protein, 54 aa, Homo sapiens
MMMSLRRSRKNLRLPVLQRRGQGFMMNWKKPRTKPGGDPLATSSLLENSLNSKC

SEQ ID NO: 33326 - protein, 27 aa, Homo sapiens
KELLTWSLRRLLMNPVSLWLTQTCVDV

SEQ ID NO: 33327 - protein, 11 aa, Homo sapiens
KYPWQTSLVTQ

SEQ ID NO: 33328 - protein, 9 aa, Homo sapiens
LCGEAAKEP

SEQ ID NO: 33329 - protein, 9 aa, Homo sapiens
LKPSCMTVW

SEQ ID NO: 33330 - protein, 16 aa, Homo sapiens
KKEKPHLGFGSCFKML

SEQ ID NO: 33331 - protein, 1440 aa, Homo sapiens
MLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRL

SEQ ID NO: 33332 - protein, 15 aa, Homo sapiens
MTSPFHLQQLGQILS

SEQ ID NO: 33333 - protein, 19 aa, Homo sapiens
QAPSICNSSAKYFHEGWQQ

SEQ ID NO: 33334 - protein, 3519 aa, Homo sapiens
MSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33335 - protein, 3594 aa, Homo sapiens
REKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33336 - protein, 9 aa, Homo sapiens
MPRAYYMFL

SEQ ID NO: 33337 - protein, 3419 aa, Homo sapiens
MAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33338 - protein, 14 aa, Homo sapiens
QTFTSCWKSWGLAI

SEQ ID NO: 33339 - protein, 2944 aa, Homo sapiens
MSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQ

SEQ ID NO: 33340 - protein, 10 aa, Homo sapiens
MSWKYGQGEE

SEQ ID NO: 33341 - protein, 3361 aa, Homo sapiens
MLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33342 - protein, 1174 aa, Homo sapiens
QYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQ

SEQ ID NO: 33343 - protein, 15 aa, Homo sapiens
ASPQWREERTRRPDI

SEQ ID NO: 33344 - protein, 13 aa, Homo sapiens
MKMMMIYARNPVV

SEQ ID NO: 33345 - protein, 606 aa, Homo sapiens
IAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTRRSQNQIQC

SEQ ID NO: 33346 - protein, 279 aa, Homo sapiens
IAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELERRSQNQIQC

SEQ ID NO: 33347 - protein, 271 aa, Homo sapiens
IAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAAAQPGPRAQPCGLWDCGERSSCCQHPCHCS

SEQ ID NO: 33348 - protein, 1369 aa, Homo sapiens
MKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQ

SEQ ID NO: 33349 - protein, 22 aa, Homo sapiens
MLGHEDLNLAKEENPERSSQFL

SEQ ID NO: 33350 - protein, 28 aa, Homo sapiens
MIPKTLKPSLKLKRSFPLTKYLNLNKIK

SEQ ID NO: 33351 - protein, 39 aa, Homo sapiens
MMKNPWSACVACSPPLAKTWTLKKQSHVWTSTLIRWRKL

SEQ ID NO: 33352 - protein, 12 aa, Homo sapiens
GCQCSRGEDKAS

SEQ ID NO: 33353 - protein, 45 aa, Homo sapiens
KNLRLPVLQRRGQGFMMNWKKPRTKPGGDPLATSSLLENSLNSKC

SEQ ID NO: 33354 - protein, 11 aa, Homo sapiens
MKKFSWYLKHS

SEQ ID NO: 33355 - protein, 25 aa, Homo sapiens
GCAIGYLEEQIKGLKLSNRFTKRLK

SEQ ID NO: 33356 - protein, 12 aa, Homo sapiens
KNKKSKGRSSNS

SEQ ID NO: 33357 - protein, 553 aa, Homo sapiens
MDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITK

SEQ ID NO: 33358 - protein, 1191 aa, Homo sapiens
MADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITK

SEQ ID NO: 33359 - protein, 29 aa, Homo sapiens
TVKCFQFKQILCPATSSTLRVHAIHACRV

SEQ ID NO: 33360 - protein, 3576 aa, Homo sapiens
MRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33361 - protein, 1384 aa, Homo sapiens
MRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFK

SEQ ID NO: 33362 - protein, 24 aa, Homo sapiens
QVPRLRYREGTASTLCTTSIDSKT

SEQ ID NO: 33363 - protein, 88 aa, Homo sapiens
KYLDSDTEKELQALYALQASIVKLDQPANLLRMFFDCLYDEEVISEDAFYKWESSKDPAEQNGKGVALKSVTAFFTWLREAEEESEDN

SEQ ID NO: 33364 - protein, 20 aa, Homo sapiens
MSSVGSLSCWRRMAWPSRRP

SEQ ID NO: 33365 - protein, 24 aa, Homo sapiens
LVEDAGSGLDQLPSGEEQVRRKRH

SEQ ID NO: 33366 - protein, 14 aa, Homo sapiens
LFPLLPPLGPMTWY

SEQ ID NO: 33367 - protein, 109 aa, Homo sapiens
ATPRCHWRVQRRPAGWGNSPSSGRRRRFWTGSATKWRRTSTTQAPLTSHDVTWMAPPSAIVPLRSCVWSLGLWGTNSMPSCETSLPALLMSSVGSLSCWRRMAWPSRRP

SEQ ID NO: 33368 - protein, 20 aa, Homo sapiens
KIPSRPSRSWLRCVSWPTAH

SEQ ID NO: 33369 - protein, 131 aa, Homo sapiens
IPDYVLGQSTCALFLSLRYHNLHPDYIHGRLQSLGKNFALRVLLVQVDVKDPQQALKELAKMCILADCTLILAWRPSPYSDLHRAFPLWTPRPRRPLRPTPNMPSHSLWKGLGPRAPQGQSPWQERRPTRP

SEQ ID NO: 33370 - protein, 8 aa, Homo sapiens
MCPGNLAT

SEQ ID NO: 33371 - protein, 38 aa, Homo sapiens
RRPLRPTPNMPSHSLWKGLGPRAPQGQSPWQERRPTRP

SEQ ID NO: 33372 - protein, 9 aa, Homo sapiens
ALGRGAIPY

SEQ ID NO: 33373 - protein, 821 aa, Homo sapiens
GGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGC

SEQ ID NO: 33374 - protein, 21 aa, Homo sapiens
MKVMKLRCIPEQMKKSLAVGG

SEQ ID NO: 33375 - protein, 111 aa, Homo sapiens
MVPFVFVGTKDSIANATVLLDYHLNYLKEVDQLRLERLQIDEQLRQIGASSRPPPNRTDKEKSYVTDDGQGMGRGSRPYRNRGHGRRGPGYTSAGSLIGRFHFMMSDSHLL

SEQ ID NO: 33376 - protein, 18 aa, Homo sapiens
RKTAPIFLNLTVQKSRGC

SEQ ID NO: 33377 - protein, 31 aa, Homo sapiens
AVPSQTAAMKGVSPTRLVTPGGDHMRLVVTC

SEQ ID NO: 33378 - protein, 10 aa, Homo sapiens
QVHWEHLPSG

SEQ ID NO: 33379 - protein, 8 aa, Homo sapiens
RGSVLQDW

SEQ ID NO: 33380 - protein, 51 aa, Homo sapiens
MSRTRNTLSAQTTLFWFRLEEEIPMVPCATSPSYTTTTITLIALLRAEETT

SEQ ID NO: 33381 - protein, 63 aa, Homo sapiens
ANALHVPGQRSQLPRDSCNPDLRWQLKWRAMCLTIHLQWQDVLLLHHRRATGRTSLVQHNFEL

SEQ ID NO: 33382 - protein, 1946 aa, Homo sapiens
MMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPV

SEQ ID NO: 33383 - protein, 9 aa, Homo sapiens
ALLRAEETT

SEQ ID NO: 33384 - protein, 11 aa, Homo sapiens
RGHVPHWRSVG

SEQ ID NO: 33385 - protein, 20 aa, Homo sapiens
MLLGLPMWSEKRGRSPTKAG

SEQ ID NO: 33386 - protein, 13 aa, Homo sapiens
TTHSTSVMKRGTC

SEQ ID NO: 33387 - protein, 27 aa, Homo sapiens
MLWKKIKKVHLLSFNKKPLAPHAQGTE

SEQ ID NO: 33388 - protein, 58 aa, Homo sapiens
KVAAQNSTFLKLQTPSPSVTCNLVFSITSLSMLWKKIKKVHLLSFNKKPLAPHAQGTE

SEQ ID NO: 33389 - protein, 18 aa, Homo sapiens
MISALSLSLMAARVPLLH

SEQ ID NO: 33390 - protein, 27 aa, Homo sapiens
VFTLSRMTRKVSLSLIPSSQRCPNSLT

SEQ ID NO: 33391 - protein, 17 aa, Homo sapiens
LRQEKVSLFLKILWTPQ

SEQ ID NO: 33392 - protein, 16 aa, Homo sapiens
MWSASLLLMAERKVPY

SEQ ID NO: 33393 - protein, 103 aa, Homo sapiens
VSPVSTNNMRAHLLEEDRKQVLIPQLALTFLILLPTLLLCTGLLLEPPSLATGSAIIPSTSVGDLEKIGCPTLGIPSPSPTSLQAQSMWSASLLLMAERKVPY

SEQ ID NO: 33394 - protein, 16 aa, Homo sapiens
AWYRICSECLQCLRTT

SEQ ID NO: 33395 - protein, 16 aa, Homo sapiens
MFRGTWKLLLRPPPAY

SEQ ID NO: 33396 - protein, 53 aa, Homo sapiens
ATGSAIIPSTSVGDLEKIGCPTLGIPSPSPTSLQAQSMWSASLLLMAERKVPY

SEQ ID NO: 33397 - protein, 24 aa, Homo sapiens
LANNQQFLMFRGTWKLLLRPPPAY

SEQ ID NO: 33398 - protein, 17 aa, Homo sapiens
MDQDQQKLKLQVQIKQK

SEQ ID NO: 33399 - protein, 15 aa, Homo sapiens
QTIPDASDRCSGQQH

SEQ ID NO: 33400 - protein, 34 aa, Homo sapiens
MARLQSREPSSQMSEATPSQVYNQALTTRSTCTP

SEQ ID NO: 33401 - protein, 22 aa, Homo sapiens
QADQLRELSPLWRMSAHQEGLV

SEQ ID NO: 33402 - protein, 3828 aa, Homo sapiens
ALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKT

SEQ ID NO: 33403 - protein, 15 aa, Homo sapiens
MAAATCQDYRLHHQV

SEQ ID NO: 33404 - protein, 89 aa, Homo sapiens
MTMLGAPLWSSTPPLPLMHHPTCVSWPPHPIPCWYHGSRHVPGLPATSSSMRSLGLLPEKWSLGPALVSQRLLLLAWNREPNIQFMSLP

SEQ ID NO: 33405 - protein, 26 aa, Homo sapiens
QWPDSNPENHQARCQKLHHHRFTTRH

SEQ ID NO: 33406 - protein, 15 aa, Homo sapiens
QCSELPCGHRRLHCH

SEQ ID NO: 33407 - protein, 129 aa, Homo sapiens
MSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGPEWLQQSLMVAAMA

SEQ ID NO: 33408 - protein, 29 aa, Homo sapiens
IGPTSMSFLSFPLLVAMKTLSSCSPTSSS

SEQ ID NO: 33409 - protein, 190 aa, Homo sapiens
VILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGPEWLQQSLMVAAMA

SEQ ID NO: 33410 - protein, 37 aa, Homo sapiens
MAGCSCWLMLVPSFGCSQSNETPWIILLRMLSVNLNS

SEQ ID NO: 33411 - protein, 17 aa, Homo sapiens
MCRRLCQGFWNKIECRV

SEQ ID NO: 33412 - protein, 26 aa, Homo sapiens
KNLPILFQTISSVDLIKLVFIHALIT

SEQ ID NO: 33413 - protein, 69 aa, Homo sapiens
LYLERSKLWDLKCLEYLLKKMVIVSTHLKKDRPLKMPLLLPMFLRLLLNLLIHPTRFKHQKSRVQPQHR

SEQ ID NO: 33414 - protein, 323 aa, Homo sapiens
MLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPENQ

SEQ ID NO: 33415 - protein, 381 aa, Homo sapiens
IQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPENQ

SEQ ID NO: 33416 - protein, 15 aa, Homo sapiens
RRNWRSGKEGSSYST

SEQ ID NO: 33417 - protein, 438 aa, Homo sapiens
MTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPENQ

SEQ ID NO: 33418 - protein, 78 aa, Homo sapiens
KESLCMMNLSTGRQQAIMLVLLWLGWISSKSMLAAYFVAPKYPLKLALVSEPESSSLILKFLSLKDFLKTSRFPDIAK

SEQ ID NO: 33419 - protein, 23 aa, Homo sapiens
QISTSLLTTRASSSQLLQWSILL

SEQ ID NO: 33420 - protein, 32 aa, Homo sapiens
ASVFAPISVVECLLQCEETENRALWLGCFRTE

SEQ ID NO: 33421 - protein, 51 aa, Homo sapiens
QRQILYPQQNPPSHTRASQLLSPGSKFQHPCLRPGPPPPSSCSGAYCCNSR

SEQ ID NO: 33422 - protein, 419 aa, Homo sapiens
QVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQVWHHSCKCFRPHQCRRVPSAVRRN

SEQ ID NO: 33423 - protein, 47 aa, Homo sapiens
RSLTLVLLVTFPKLCAQPTYSHVTTELLKLFLGYHFVKLLICGHWAV

SEQ ID NO: 33424 - protein, 32 aa, Homo sapiens
MLVLPMLSDNNNPVPSLRRRISSQLQSLPSPL

SEQ ID NO: 33425 - protein, 22 aa, Homo sapiens
LTGGMPTLMATSTALSCSSHPC

SEQ ID NO: 33426 - protein, 22 aa, Homo sapiens
LEECPLSWQPVQHYHAAAILAD

SEQ ID NO: 33427 - protein, 17 aa, Homo sapiens
MSSVMSLSMILQTLTLL

SEQ ID NO: 33428 - protein, 8 aa, Homo sapiens
AALIPLIP

SEQ ID NO: 33429 - protein, 31 aa, Homo sapiens
VLSEAIVDPFWRGLAELWQMALAPALSLCLH

SEQ ID NO: 33430 - protein, 74 aa, Homo sapiens
ISYVTVNDSPDSDSSLSSPYSTDTLSALRGNSGSVLEGPGRVVADGTGTRTIIVPPLKTQLGDCTVATQASALD

SEQ ID NO: 33431 - protein, 3073 aa, Homo sapiens
MDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPS

SEQ ID NO: 33432 - protein, 3085 aa, Homo sapiens
QATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPS

SEQ ID NO: 33433 - protein, 10 aa, Homo sapiens
KQQQSILDSL

SEQ ID NO: 33434 - protein, 2965 aa, Homo sapiens
MGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPS

SEQ ID NO: 33435 - protein, 38 aa, Homo sapiens
AAQPAGRRWLNRLPLYCRRGLEGLSKFSCLQLGNSCLG

SEQ ID NO: 33436 - protein, 20 aa, Homo sapiens
MRSDRPLHAGAVRPLQSGKI

SEQ ID NO: 33437 - protein, 13 aa, Homo sapiens
KTHTESYAHHLSL

SEQ ID NO: 33438 - protein, 159 aa, Homo sapiens
QLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGFLLTYHLSQRKMVPIKLRQRSMTFI

SEQ ID NO: 33439 - protein, 12 aa, Homo sapiens
AQELEASKASRN

SEQ ID NO: 33440 - protein, 8 aa, Homo sapiens
MGERGLSI

SEQ ID NO: 33441 - protein, 243 aa, Homo sapiens
LHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAV

SEQ ID NO: 33442 - protein, 22 aa, Homo sapiens
AQSGNLGRLLTPLSMGERGLSI

SEQ ID NO: 33443 - protein, 127 aa, Homo sapiens
MYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAV

SEQ ID NO: 33444 - protein, 25 aa, Homo sapiens
LESGCGADESPSRGEWIFEHHVCQR

SEQ ID NO: 33445 - protein, 10 aa, Homo sapiens
LSMGERGLSI

SEQ ID NO: 33446 - protein, 61 aa, Homo sapiens
ASCMSTVTSVGTSASPPGSRLSVLRYRAHQHFSFRMVVSTCLSGELWKPVPLSEWKGTTVR

SEQ ID NO: 33447 - protein, 13 aa, Homo sapiens
QVWEPALLHQDHV

SEQ ID NO: 33448 - protein, 16 aa, Homo sapiens
VCSDIGLTSISASGWL

SEQ ID NO: 33449 - protein, 29 aa, Homo sapiens
MSASLWPRRLALSRALQKQPRVCWVAPSP

SEQ ID NO: 33450 - protein, 13 aa, Homo sapiens
VANAVCLPTFRSD

SEQ ID NO: 33451 - protein, 20 aa, Homo sapiens
MFIQRWGWQLLRPLVPVKVQ

SEQ ID NO: 33452 - protein, 28 aa, Homo sapiens
QLGSHHWDGGPGALPHQCLQVSGPAGWH

SEQ ID NO: 33453 - protein, 234 aa, Homo sapiens
KETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVASISKGDFRLFLLV

SEQ ID NO: 33454 - protein, 22 aa, Homo sapiens
RRLQIVPTCLSGERSMPAHLSI

SEQ ID NO: 33455 - protein, 68 aa, Homo sapiens
LNVHSKMGLATPSTSRPCQGTVTTGKPSLGRGTRSTTSSMSASLWPRRLALSRALQKQPRVCWVAPSP

SEQ ID NO: 33456 - protein, 34 aa, Homo sapiens
MSRWDSEKVNHHPIHLQREPSELQAHVHQRRGGL

SEQ ID NO: 33457 - protein, 16 aa, Homo sapiens
ALPHQCLQVSGPAGWH

SEQ ID NO: 33458 - protein, 38 aa, Homo sapiens
AVPSRSSRVSAGWLQAREPRQGKGRTSVERWHNCPEIR

SEQ ID NO: 33459 - protein, 28 aa, Homo sapiens
MSICGENENCPPGVASISKGDFRLFLLV

SEQ ID NO: 33460 - protein, 12 aa, Homo sapiens
LPGHQPKHRTPV

SEQ ID NO: 33461 - protein, 78 aa, Homo sapiens
MSCLPLPLSAERIRPSLFLPPSSSTVTLWWRTGSPSSVTRLPTASTSSLGTPQPCVLWGLISTAALTTSAGTPGLPAP

SEQ ID NO: 33462 - protein, 17 aa, Homo sapiens
AVQSLWGHEDQWGQLPV

SEQ ID NO: 33463 - protein, 19 aa, Homo sapiens
QDQVLPSRRRSRCRVCLFL

SEQ ID NO: 33464 - protein, 995 aa, Homo sapiens
KLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPL

SEQ ID NO: 33465 - protein, 843 aa, Homo sapiens
MVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPL

SEQ ID NO: 33466 - protein, 17 aa, Homo sapiens
QVLPSRRRSRCRVCLFL

SEQ ID NO: 33467 - protein, 937 aa, Homo sapiens
KYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPL

SEQ ID NO: 33468 - protein, 6583 aa, Homo sapiens
MTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33469 - protein, 31 aa, Homo sapiens
ILTAISLKMWSLHLLQTALRFGGNLKMVWKM

SEQ ID NO: 33470 - protein, 8 aa, Homo sapiens
ASAHAGLT

SEQ ID NO: 33471 - protein, 34 aa, Homo sapiens
LDVSATKWNLVTTLPPWITTSMKRRKPTWGLGLA

SEQ ID NO: 33472 - protein, 6113 aa, Homo sapiens
MEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33473 - protein, 31 aa, Homo sapiens
MMTTRWCHYHQAQDMSSFLGRCALRREQTTR

SEQ ID NO: 33474 - protein, 8 aa, Homo sapiens
RGLFGVFH

SEQ ID NO: 33475 - protein, 42 aa, Homo sapiens
QHTIFHGVRHPNSLRATATRPLGKSCHHSAATWKDSNQQPMW

SEQ ID NO: 33476 - protein, 6135 aa, Homo sapiens
AGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33477 - protein, 29 aa, Homo sapiens
VPSARICQCLLQSRHWPVPLFPGSVCSAV

SEQ ID NO: 33478 - protein, 18 aa, Homo sapiens
LRPSDWGVLELPGLHHGS

SEQ ID NO: 33479 - protein, 43 aa, Homo sapiens
MGHNCESLFSCHTVNHWTSSPWEVQEMGWSPTVPGKPFRDTDV

SEQ ID NO: 33480 - protein, 5830 aa, Homo sapiens
MGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33481 - protein, 50 aa, Homo sapiens
KVLGWLLWRPHHWVRRSLPPLPLPRWSRQWTPVCQELLPRSCYFTACLCL

SEQ ID NO: 33482 - protein, 27 aa, Homo sapiens
QGDWEVSQVPVPHGRGTLSVLPVWILW

SEQ ID NO: 33483 - protein, 14 aa, Homo sapiens
LPVRQSHWSVLVSS

SEQ ID NO: 33484 - protein, 5729 aa, Homo sapiens
KETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33485 - protein, 23 aa, Homo sapiens
AREGTRGSSLTAHPATSALLSGM

SEQ ID NO: 33486 - protein, 42 aa, Homo sapiens
LHTLPPVLCSLGCDHCRADQQDTQIPGESQGLEDQWCDRALP

SEQ ID NO: 33487 - protein, 288 aa, Homo sapiens
TRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33488 - protein, 127 aa, Homo sapiens
MSLEAEERVNASTTEPNSTVEQSALMRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33489 - protein, 12 aa, Homo sapiens
KTSWRRAPQQSH

SEQ ID NO: 33490 - protein, 102 aa, Homo sapiens
MRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33491 - protein, 35 aa, Homo sapiens
KNLLNNWNLSKTQIFGVPWIALPSISRCLLRQRRG

SEQ ID NO: 33492 - protein, 16 aa, Homo sapiens
MPPPQNPTALWSSQPS

SEQ ID NO: 33493 - protein, 48 aa, Homo sapiens
GRGEGECLHHRTQQHCGAVSPHERQSRRRDDGARIPVQGKTRGAGSPP

SEQ ID NO: 33494 - protein, 172 aa, Homo sapiens
AKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33495 - protein, 25 aa, Homo sapiens
MGLSVKCRYTPGLCLSQPFSSLFSP

SEQ ID NO: 33496 - protein, 89 aa, Homo sapiens
APAMSDSSPSVTCCRVQPSWWLSPTAGFWRPWPAPCTLSSSATCCSLMWLLSSHFGSCCISSFTMGLSVKCRYTPGLCLSQPFSSLFSP

SEQ ID NO: 33497 - protein, 24 aa, Homo sapiens
AQPQGSGDPGQLPAHSQVPPPAVL

SEQ ID NO: 33498 - protein, 23 aa, Homo sapiens
MKGPSYWAHVGPAGMLLSDVLQP

SEQ ID NO: 33499 - protein, 51 aa, Homo sapiens
VLASGNQGLVAHPAASVERPPEAGPHPEMKGPSYWAHVGPAGMLLSDVLQP

SEQ ID NO: 33500 - protein, 20 aa, Homo sapiens
ASAHSPWGCQSSVAILLACA

SEQ ID NO: 33501 - protein, 39 aa, Homo sapiens
MRLLAPSGHLLLQQPPPLPLLLHPHTNGHQLAQPHSLSP

SEQ ID NO: 33502 - protein, 15 aa, Homo sapiens
RVPLIGLTSAPPGCC

SEQ ID NO: 33503 - protein, 64 aa, Homo sapiens
MTSFLLWLARRRMAKRWRLGKWLVELWMDQIPAAWGFQHWKLHKDSAASPPWSYSQFHSPQRQP

SEQ ID NO: 33504 - protein, 29 aa, Homo sapiens
GSWHQAVTFCSSSHLLCLFFYILIQTGTS

SEQ ID NO: 33505 - protein, 24 aa, Homo sapiens
APKAFQASCREEGCSHPSGAWCRV

SEQ ID NO: 33506 - protein, 9 aa, Homo sapiens
MSPPCPASQ

SEQ ID NO: 33507 - protein, 23 aa, Homo sapiens
APGCHWRASHSPTMAWALTSSAC

SEQ ID NO: 33508 - protein, 26 aa, Homo sapiens
MSLRRRSWLPYLRRRLLWLLLLGRRA

SEQ ID NO: 33509 - protein, 9 aa, Homo sapiens
VPCTAGSRH

SEQ ID NO: 33510 - protein, 15 aa, Homo sapiens
MSMVQQQRPRLWRRD

SEQ ID NO: 33511 - protein, 67 aa, Homo sapiens
KFAPAAAPAESSVACGWRKECAHHQCPPLRQQCPPPWEHHWLCAQCRCLCQVLSPPPVEHPLSVWDR

SEQ ID NO: 33512 - protein, 62 aa, Homo sapiens
MCSSPVPSLTSTMSPTLGTSLVVCSVPMSLPGTLASASGTPSICVGQMSMVQQQRPRLWRRD

SEQ ID NO: 33513 - protein, 28 aa, Homo sapiens
ADQNHPGHFPAVAETRFCAARYCGATAM

SEQ ID NO: 33514 - protein, 11 aa, Homo sapiens
QVWQAHQCCRA

SEQ ID NO: 33515 - protein, 285 aa, Homo sapiens
MLSSLRSLSVKSADHALWCSRASTCFWTCLRLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKVACGWRKECAHHQCPPLRQQCPPPWEHHWLCAQCRCLCQVLSPPPVEHPLSVWDR

SEQ ID NO: 33516 - protein, 18 aa, Homo sapiens
MPSLSPVLGFGMASSHAA

SEQ ID NO: 33517 - protein, 16 aa, Homo sapiens
AGEATGGVVGEDIAWQ

SEQ ID NO: 33518 - protein, 37 aa, Homo sapiens
LDTQCPVYHPFLASGWPQATLHNPRPQMGNPCTLRRF

SEQ ID NO: 33519 - protein, 69 aa, Homo sapiens
MGIYSIKKFGLTTSRGRDRVGVGIRSSYIRVLGIQVDTDGSEIRLGAPNAHWTRTSSCPTNANAWTSRP

SEQ ID NO: 33520 - protein, 32 aa, Homo sapiens
GWAPQMPIGPVLHHARQMQMRGLPDPEAAGAA

SEQ ID NO: 33521 - protein, 27 aa, Homo sapiens
QGRPWEQGYHHGHLLHQEVWPDYQQGP

SEQ ID NO: 33522 - protein, 133 aa, Homo sapiens
AGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSEIRLGAPNAHWTRTSSCPTNANAWTSRP

SEQ ID NO: 33523 - protein, 25 aa, Homo sapiens
LGAPNAHWTRTSSCPTNANAWTSRP

SEQ ID NO: 33524 - protein, 305 aa, Homo sapiens
MLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGTCVTRSSLGTGLPSWASTPSRSLA

SEQ ID NO: 33525 - protein, 31 aa, Homo sapiens
RRRSSVAWLPSQMSMRSSPRASPPPSLGAQT

SEQ ID NO: 33526 - protein, 250 aa, Homo sapiens
MVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGTCVTRSSLGTGLPSWASTPSRSLA

SEQ ID NO: 33527 - protein, 69 aa, Homo sapiens
QPADARGPWDSQVPASEVCGEVFSHWGIHVWERQQRSWTDSLGDEGPFVPEFHHGGRSHGPGRWWGRLY

SEQ ID NO: 33528 - protein, 1613 aa, Homo sapiens
MRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQ

SEQ ID NO: 33529 - protein, 14 aa, Homo sapiens
MAAPSLCSPSPRLS

SEQ ID NO: 33530 - protein, 11 aa, Homo sapiens
AGARAGTEEGQ

SEQ ID NO: 33531 - protein, 240 aa, Homo sapiens
IPVVTNSPQPLPPPPPLPAAAQPLPLAPRQPALVGAPGLSIKEPAPLPSRPQVPTPAPLLPDSKATIPPNGSPKPLQPLPTPVLTIAPHPGVQPQLAPQQPPPPTLGTLKLAPAEEVKSSEQKKRPGGIGTREVHNKLEKNRRAHLKECFETLKRNIPNVDDKKTSNLSVLRTALRYIQRSRSGFAWSRSESRNRRRPIAWPGWHIPFLWRNPAWRRHPCLCLHRLPRRHPHHHLPPLPH

SEQ ID NO: 33532 - protein, 10 aa, Homo sapiens
MMKTLRRKSE

SEQ ID NO: 33533 - protein, 9 aa, Homo sapiens
QRLFLLPHF

SEQ ID NO: 33534 - protein, 38 aa, Homo sapiens
RLRLQLNSLPLASPLLTTTIPITTFLKHKMSPVMFHTL

SEQ ID NO: 33535 - protein, 23 aa, Homo sapiens
KVNLRKLSKNSYTIQTCTCSSRN

SEQ ID NO: 33536 - protein, 26 aa, Homo sapiens
IRSPEDATSDTLSSSRRSAGCDQTGI

SEQ ID NO: 33537 - protein, 2356 aa, Homo sapiens
RSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQ

SEQ ID NO: 33538 - protein, 45 aa, Homo sapiens
IRKLLLLTPLGRGQSEYPTVHADLACGRCTEYSYKLRFNGTSIRR

SEQ ID NO: 33539 - protein, 22 aa, Homo sapiens
IPNCSRRPRLWQMHRIFLQAPF

SEQ ID NO: 33540 - protein, 2238 aa, Homo sapiens
MAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQ

SEQ ID NO: 33541 - protein, 33 aa, Homo sapiens
ASIRGHPGGGIVGRGRSGSFSGDAAGSYSHYGA

SEQ ID NO: 33542 - protein, 28 aa, Homo sapiens
GHLTRWGTDRLVWGNRSSRRSTYWSPRC

SEQ ID NO: 33543 - protein, 114 aa, Homo sapiens
QASEATQAVASLAEAAVAASQEMQQGATVTMALNSEAAAHAVATLAEATLQGGGQIVLSGETAAAVGALTGVQDANVELHGGTRSDPNRTYGYHRSTCSGPASAAGPCGYLHRA

SEQ ID NO: 33544 - protein, 491 aa, Homo sapiens
MLMNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANELHGGTRSDPNRTYGYHRSTCSGPASAAGPCGYLHRA

SEQ ID NO: 33545 - protein, 564 aa, Homo sapiens
KHQRPPRRWHRWQRPQWQLLRRCSRELQSLWRLTAKLPPMLSPPWLRPPYKVGDRSSCLGKPQQPSEHLLESKMLMNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANELHGGTRSDPNRTYGYHRSTCSGPASAAGPCGYLHRA

SEQ ID NO: 33546 - protein, 28 aa, Homo sapiens
VLMKTRLLLPRTPLTMTQIYSTPQQLMR

SEQ ID NO: 33547 - protein, 15 aa, Homo sapiens
GPASAAGPCGYLHRA

SEQ ID NO: 33548 - protein, 1144 aa, Homo sapiens
MAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQ

SEQ ID NO: 33549 - protein, 1203 aa, Homo sapiens
VAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQ

SEQ ID NO: 33550 - protein, 34 aa, Homo sapiens
LKTVPWEVLQTQWQGFFGDVWKTCRKLIAFPKSS

SEQ ID NO: 33551 - protein, 37 aa, Homo sapiens
AHHFSGSPNGLITLTNMALGTSSQTTPSVSFSTMVLT

SEQ ID NO: 33552 - protein, 18 aa, Homo sapiens
LHSQRAAEHIISVGHQMG

SEQ ID NO: 33553 - protein, 170 aa, Homo sapiens
QIWLWVPALRPHRRCPFQQWCSHEPPSRQKELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKSSSHLPPQLPGLEHPQ

SEQ ID NO: 33554 - protein, 125 aa, Homo sapiens
MARSSRLGARRHNQHHLVAMVDTESPLCPLSPLEAGDLESPLSEEFLQEMGNIQEISQSIGEDSSGSFGFTEYQYLGSCPGSDGSVITAWSSAAQPAPSGRDGGHGKPTLPPLPTRGRRSREPVI

SEQ ID NO: 33555 - protein, 17 aa, Homo sapiens
MARSSRTRFHQLRAPPR

SEQ ID NO: 33556 - protein, 253 aa, Homo sapiens
MTSATAAARSRKRTETNASIVDFTSAFLSGCHTTLGARRHNQHHLVAMVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAWSSAAQPAPSGRDGGHGKPTLPPLPTRGRRSREPVI

SEQ ID NO: 33557 - protein, 588 aa, Homo sapiens
MNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNP

SEQ ID NO: 33558 - protein, 10 aa, Homo sapiens
KQKFLPVNMT

SEQ ID NO: 33559 - protein, 19 aa, Homo sapiens
KILKLQISNLWPRESTRPT

SEQ ID NO: 33560 - protein, 663 aa, Homo sapiens
IQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNP

SEQ ID NO: 33561 - protein, 72 aa, Homo sapiens
MLSSVMNKDGMLVAYGNGFITREFLKSLRKPFCDIMEPKFDFAMKFNALELDDSDISLFVAAIICCGAFCHT

SEQ ID NO: 33562 - protein, 54 aa, Homo sapiens
QWHPEQGGGGPHLSLLPVHVSGDRHGAHGIRQGHPRLRKLGPERSSDIAKIRSL

SEQ ID NO: 33563 - protein, 26 aa, Homo sapiens
GHIRHAVFCDEQRRDAGSVWKWVYNS

SEQ ID NO: 33564 - protein, 69 aa, Homo sapiens [sequence omitted]

SEQ ID NO: 33565 - protein, 69 aa, Homo sapiens
AAGDGACAAGADHQEDGVGCCAAPATAGDLQGHVLSSFRSATPFPGVLKLTALQRRRGSSTILHKYPPL

SEQ ID NO: 33566 - protein, 100 aa, Homo sapiens
MPTGKMQLPSQGLSPRPRRPPLRKSPWLSRQPPTPRQQRGSVCWKKWKSSPGRRRRAMCYRCSASCLSLTRPHSPGWREAGGCSDSMTWRPPMTAHYSPD

SEQ ID NO: 33567 - protein, 33 aa, Homo sapiens
MRAWTKPTWRMLDTPAQTRQPQRTISSSISVPV

SEQ ID NO: 33568 - protein, 21 aa, Homo sapiens
MLPRKGCGKTQFFLKFCLNSQ

SEQ ID NO: 33569 - protein, 11 aa, Homo sapiens
KLCQCTSILNY

SEQ ID NO: 33570 - protein, 8 aa, Homo sapiens
ALPVHVHT

SEQ ID NO: 33571 - protein, 31 aa, Homo sapiens
MQATRMHQNILCIFWRYIDLPSKALPVHVHT

SEQ ID NO: 33572 - protein, 15 aa, Homo sapiens
LHPPGYCFIKTMCRI

SEQ ID NO: 33573 - protein, 150 aa, Homo sapiens
MRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTESIN

SEQ ID NO: 33574 - protein, 144 aa, Homo sapiens
LKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTESIN

SEQ ID NO: 33575 - protein, 38 aa, Homo sapiens
MAPPHHPMASAMGLPLLPPPLWLINSCPQPVVPGNSAS

SEQ ID NO: 33576 - protein, 27 aa, Homo sapiens
ADSSNNATSPNYSRSSKNQFIYTDNVN

SEQ ID NO: 33577 - protein, 22 aa, Homo sapiens
MNSCFWMPAPPHLLTPQSCFSM

SEQ ID NO: 33578 - protein, 16 aa, Homo sapiens
QLKNFIPNCKKLLTSH

SEQ ID NO: 33579 - protein, 33 aa, Homo sapiens
MISVKRNTWRALSLVIGDCRKKGNFEYCQEQEA

SEQ ID NO: 33580 - protein, 50 aa, Homo sapiens
RPTCPCCSVSSSTAQDWPNRTLPSTSPSMNSCFWMPAPPHLLTPQSCFSM

SEQ ID NO: 33581 - protein, 9 aa, Homo sapiens
ISFQTARSY

SEQ ID NO: 33582 - protein, 19 aa, Homo sapiens
APPLRKTGQTEPCPVPRPA

SEQ ID NO: 33583 - protein, 60 aa, Homo sapiens
TAYPTSPMACLTLPHLHLSITVWMIWPLPTTTGTPIDTPATGTSGTETDLWGCMAHVKKK

SEQ ID NO: 33584 - protein, 2072 aa, Homo sapiens
MIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVAL

SEQ ID NO: 33585 - protein, 1868 aa, Homo sapiens
GLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSE

SEQ ID NO: 33586 - protein, 89 aa, Homo sapiens
MALTESLCTQNIQASDHALLAQASGTVQITAYPTSPMACLTLPHLHLSITVWMIWPLPTTTGTPIDTPATGTSGTETDLWGCMAHVKKK

SEQ ID NO: 33587 - protein, 10 aa, Homo sapiens
GGVKKQTGKN

SEQ ID NO: 33588 - protein, 12 aa, Homo sapiens
ITGSGGTVTPRT

SEQ ID NO: 33589 - protein, 1977 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVAL

SEQ ID NO: 33590 - protein, 29 aa, Homo sapiens
TRIGNSFTGLRLDTCQRRSGRKLRRPSMR

SEQ ID NO: 33591 - protein, 35 aa, Homo sapiens
AAESRQPRPSCTRRASGIPSQACVWIRARGDLEES

SEQ ID NO: 33592 - protein, 9 aa, Homo sapiens
ALETVLSGF

SEQ ID NO: 33593 - protein, 13 aa, Homo sapiens
KHFFPVFSYTSWF

SEQ ID NO: 33594 - protein, 52 aa, Homo sapiens
VAFKYLHRGNPKVCFKSLKSNIFKSISSLYFHIQVGFNFVWVVLFFLNDFLV

SEQ ID NO: 33595 - protein, 230 aa, Homo sapiens
TKTGRGELQTDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRSY

SEQ ID NO: 33596 - protein, 37 aa, Homo sapiens
MIWPLPTTTGTPIDTPATGTSGTETDLWGCMAHVKKK

SEQ ID NO: 33597 - protein, 101 aa, Homo sapiens
TGRGELQTEPKKMALTESLCTQNIQASDHALLAQASGTVQITAYPTSPMACLTLPHLHLSITVWMIWPLPTTTGTPIDTPATGTSGTETDLWGCMAHVKKK

SEQ ID NO: 33598 - protein, 31 aa, Homo sapiens
GCVDNQSLQGWEDTSPNTYTPGISLKSKTIH

SEQ ID NO: 33599 - protein, 96 aa, Homo sapiens
LCRQPKFTRLGRHFSKYIYTRHFFKIKNNPLALGRGVGGGLNVGLGNSFKWLLSICIEAILRFALSLLNLTFLKAFLPCIFIYKLVLILFGWCYFF

SEQ ID NO: 33600 - protein, 17 aa, Homo sapiens
KSNLLTFFEVKHSMNVS

SEQ ID NO: 33601 - protein, 391 aa, Homo sapiens
MLVCYSVLACEILWDLPCSIMGSPLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVIDWSDVRKHKYGHLSESASQYQEAADILDLGL

SEQ ID NO: 33602 - protein, 12 aa, Homo sapiens
MGVCYSHLLDFG

SEQ ID NO: 33603 - protein, 19 aa, Homo sapiens
MIRETTQGCHDHIFTSILH

SEQ ID NO: 33604 - protein, 53 aa, Homo sapiens
KLWTGRTLISFAQPLLGRFGAQRCLSLLMGGEGPLTTGAASTPETSSLWAGVP

SEQ ID NO: 33605 - protein, 220 aa, Homo sapiens
MKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVLHTSKQRVQDQYEIGSTGPQEHHIHLYCHSSWTDRCPPSPAP

SEQ ID NO: 33606 - protein, 25 aa, Homo sapiens
MLENTNMVTYQSLHPNIKKLLTSWI

SEQ ID NO: 33607 - protein, 9 aa, Homo sapiens
MRLLGPCSF

SEQ ID NO: 33608 - protein, 55 aa, Homo sapiens
MFSPSACPLLQAVLHTSKQRVQDQYEIGSTGPQEHHIHLYCHSSWTDRCPPSPAP

SEQ ID NO: 33609 - protein, 24 aa, Homo sapiens
MAQRGSVLLHYRGNFKKCWFATVF

SEQ ID NO: 33610 - protein, 366 aa, Homo sapiens
MLPPSPAQPCRPQQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVLHTSKQRVQDQYEIGSTGPQEHHIHLYCHSSWTDRCPPSPAP

SEQ ID NO: 33611 - protein, 12 aa, Homo sapiens
LETTCSLLAPKL

SEQ ID NO: 33612 - protein, 36 aa, Homo sapiens
ILRSPASTAAPKLSWNINQGRGGVNQERSGAGHPRP

SEQ ID NO: 33613 - protein, 21 aa, Homo sapiens
LYRLCLSPENRLQLPQARPWW

SEQ ID NO: 33614 - protein, 1595 aa, Homo sapiens
MDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSR

SEQ ID NO: 33615 - protein, 1705 aa, Homo sapiens
ACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSR

SEQ ID NO: 33616 - protein, 38 aa, Homo sapiens
MGATTKMTSGGWLTQLKSSLLGTVKRMGVCYSHLLDFG

SEQ ID NO: 33617 - protein, 67 aa, Homo sapiens
MGATTKMTSGGWLTQLKSSLLGTVKRMGVCYSHLLHLVLFAWPKGALCCSTTEETSRNAGLLQCFSL

SEQ ID NO: 33618 - protein, 26 aa, Homo sapiens
MEQRWLPSGFSTRSHHRLPTTSSKWE

SEQ ID NO: 33619 - protein, 1218 aa, Homo sapiens
ARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTK

SEQ ID NO: 33620 - protein, 28 aa, Homo sapiens
AAPKLSWNINQGRGGVNQERSGAGHPRP

SEQ ID NO: 33621 - protein, 1729 aa, Homo sapiens
KKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSR

SEQ ID NO: 33622 - protein, 30 aa, Homo sapiens
QSVWQPALYTDSLVTHCHRVQPQPRQVPTR

SEQ ID NO: 33623 - protein, 1043 aa, Homo sapiens
MMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWL

SEQ ID NO: 33624 - protein, 1119 aa, Homo sapiens
LVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWL

SEQ ID NO: 33625 - protein, 933 aa, Homo sapiens
MFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWL

SEQ ID NO: 33626 - protein, 18 aa, Homo sapiens
MLWSFGCKLAWMGSRFGT

SEQ ID NO: 33627 - protein, 73 aa, Homo sapiens
RALCWVQFTRTRRMMSLRLTCCRSTPILAPRKILTVSCNRLKKRASVSFWTLLPTTGVRTRGSPLRLTLWPPR

SEQ ID NO: 33628 - protein, 19 aa, Homo sapiens
RMLWSFGCKLAWMGSRFGT

SEQ ID NO: 33629 - protein, 367 aa, Homo sapiens
IKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKAP

SEQ ID NO: 33630 - protein, 32 aa, Homo sapiens
RWQAAPAGYAPAGHCCCSSGSAGSACLLVPWS

SEQ ID NO: 33631 - protein, 13 aa, Homo sapiens
QGGGRRGGGGSRG

SEQ ID NO: 33632 - protein, 309 aa, Homo sapiens
IVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKAP

SEQ ID NO: 33633 - protein, 153 aa, Homo sapiens
MRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEAAGSHRTPNSGT

SEQ ID NO: 33634 - protein, 21 aa, Homo sapiens
MQKDRRLPLGRMASLWTRPAR

SEQ ID NO: 33635 - protein, 64 aa, Homo sapiens
MPSKMSMMNMACPRPLHVACSPTMPWPMLSLREWTSSQRLWSMVSSNSTRSKVWSGWCPCTTTT

SEQ ID NO: 33636 - protein, 104 aa, Homo sapiens
TASWPTRWAWGRPSRPSRSSRTSWSTNASMGPSSSSCLSRMPSKMSMMNMACPRPLHVACSPTMPWPMLSLREWTSSQRLWSMVSSNSTRSKVWSGWCPCTTTT

SEQ ID NO: 33637 - protein, 22 aa, Homo sapiens
MVSSNSTRSKVWSGWCPCTTTT

SEQ ID NO: 33638 - protein, 548 aa, Homo sapiens
MGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAK

SEQ ID NO: 33639 - protein, 634 aa, Homo sapiens
IVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAK

SEQ ID NO: 33640 - protein, 26 aa, Homo sapiens
RCLTRDPQQQDGPLSPSSGVGSSTSC

SEQ ID NO: 33641 - protein, 113 aa, Homo sapiens
QVGPLRGEGVLQGIPSSKTGLCPPAPEWEVQRLADDVRVHHQRQAHPRQDQRFGVAGVPVQQQPERHPGRRDGPGEDHPDHRAHHVPHGAQTHQWALPHHRASLNAVQLGVRV

SEQ ID NO: 33642 - protein, 9 aa, Homo sapiens
QCTDTQTPA

SEQ ID NO: 33643 - protein, 21 aa, Homo sapiens
MSSGSGNTYWNCSGPGDSGSR

SEQ ID NO: 33644 - protein, 901 aa, Homo sapiens
MPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33645 - protein, 8 aa, Homo sapiens
APGGEAHL

SEQ ID NO: 33646 - protein, 14 aa, Homo sapiens
AHKTGETGTARPQI

SEQ ID NO: 33647 - protein, 9 aa, Homo sapiens
GRHKKARGH

SEQ ID NO: 33648 - protein, 28 aa, Homo sapiens
MANTYLVWKTCYRSTPWLKQTLASRQSG

SEQ ID NO: 33649 - protein, 28 aa, Homo sapiens
ASQRGRTMSSGSGNTYWNCSGPGDSGSR

SEQ ID NO: 33650 - protein, 669 aa, Homo sapiens
AHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33651 - protein, 1027 aa, Homo sapiens
MRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33652 - protein, 68 aa, Homo sapiens
MLMTLMPGCWTSSRLSPAATWATMSIPHSLWSRNTRTWRKRSPITGPPLTRCTNKPAPSPRSMPSLQT

SEQ ID NO: 33653 - protein, 21 aa, Homo sapiens
AGHQGRRRHDRGGALRVGEDP

SEQ ID NO: 33654 - protein, 23 aa, Homo sapiens
AALGHSEEAPGGGLPAAPVPGRC

SEQ ID NO: 33655 - protein, 32 aa, Homo sapiens
TWRKRSPITGPPLTRCTNKPAPSPRSMPSLQT

SEQ ID NO: 33656 - protein, 847 aa, Homo sapiens
MFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33657 - protein, 48 aa, Homo sapiens
RTLWPCTRCSARLMPVSSGSTRRSSGSTTCRSQRSWRIWRSSSTDLRA

SEQ ID NO: 33658 - protein, 29 aa, Homo sapiens
ALDRREGAVAQQHADPREAGGSGGHPAQI

SEQ ID NO: 33659 - protein, 785 aa, Homo sapiens
MHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33660 - protein, 33 aa, Homo sapiens
MKPNPGFGKRPRSSSPPRTWAMTWLASWPCSAS

SEQ ID NO: 33661 - protein, 42 aa, Homo sapiens
ASRTTTSSAMKPNPGFGKRPRSSSPPRTWAMTWLASWPCSAS

SEQ ID NO: 33662 - protein, 34 aa, Homo sapiens
VTCRRRRRSWSPSTPTRPRPSCLGWPRSATCGRR

SEQ ID NO: 33663 - protein, 654 aa, Homo sapiens
MKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33664 - protein, 611 aa, Homo sapiens
MPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33665 - protein, 563 aa, Homo sapiens
MFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33666 - protein, 9 aa, Homo sapiens
QPGVCSGSH

SEQ ID NO: 33667 - protein, 504 aa, Homo sapiens
MPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33668 - protein, 30 aa, Homo sapiens
MWRTRSCGLERGCLWQLPRIMATTSRLCSC

SEQ ID NO: 33669 - protein, 48 aa, Homo sapiens
TRGSITCWPPKRSISSTGMWRTRSCGLERGCLWQLPRIMATTSRLCSC

SEQ ID NO: 33670 - protein, 93 aa, Homo sapiens
MSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33671 - protein, 28 aa, Homo sapiens
TTSLRGAKTSSLTAAASALRPSDRGLPT

SEQ ID NO: 33672 - protein, 17 aa, Homo sapiens
GHQTEACRPEAAVGSPH

SEQ ID NO: 33673 - protein, 13 aa, Homo sapiens
AHQLWTFRCRHHR

SEQ ID NO: 33674 - protein, 1559 aa, Homo sapiens
MVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEE

SEQ ID NO: 33675 - protein, 28 aa, Homo sapiens
LGEIRTQWRPYRECTLHLSMTSRLWAHR

SEQ ID NO: 33676 - protein, 88 aa, Homo sapiens
GSCRRMQPASRRPMRVTRPTISRSARTRSWKPGSPSWTPVRAAGCGWWTQGTSSASSAWCATSCSGWRMSSGRSRPRRSQGMYHLLNS

SEQ ID NO: 33677 - protein, 23 aa, Homo sapiens
QGRRYPEARERGPGSLEVPPGRL

SEQ ID NO: 33678 - protein, 933 aa, Homo sapiens
VEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33679 - protein, 875 aa, Homo sapiens
LALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33680 - protein, 1175 aa, Homo sapiens
MNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33681 - protein, 1235 aa, Homo sapiens
AIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33682 - protein, 636 aa, Homo sapiens
MAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33683 - protein, 579 aa, Homo sapiens
MIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33684 - protein, 18 aa, Homo sapiens
ACRVSRREGQAVGHRGAV

SEQ ID NO: 33685 - protein, 826 aa, Homo sapiens
MQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33686 - protein, 15 aa, Homo sapiens
AGQTQHKVEPVQRTG

SEQ ID NO: 33687 - protein, 25 aa, Homo sapiens
RTNSTQGGASSENWLTGRRMPSCLP

SEQ ID NO: 33688 - protein, 709 aa, Homo sapiens
MALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33689 - protein, 22 aa, Homo sapiens
MRRCSQPRTCLTMKPEICTVNG

SEQ ID NO: 33690 - protein, 481 aa, Homo sapiens
ANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33691 - protein, 42 aa, Homo sapiens
RTTGIYRNSCKIVKSCLSGSMRRCSQPRTCLTMKPEICTVNG

SEQ ID NO: 33692 - protein, 11 aa, Homo sapiens
MAARPGESDSV

SEQ ID NO: 33693 - protein, 11 aa, Homo sapiens
IHYPDKGPAAL

SEQ ID NO: 33694 - protein, 15 aa, Homo sapiens
KECSSFQKSLRRKLW

SEQ ID NO: 33695 - protein, 40 aa, Homo sapiens
RRNSLVYIKCGKSLNPLPRQRPSGSLMQTRPNFSPRAVQI

SEQ ID NO: 33696 - protein, 26 aa, Homo sapiens
MRLSGATTSLNRWVRMAGVMSQLPSR

SEQ ID NO: 33697 - protein, 68 aa, Homo sapiens
ARRNLSPPLQRLRDWGHHHCPCHPGPGWLSTDREHPAILCQRPVHSLTGGPNPGSCSAQKSLSQEAQG

SEQ ID NO: 33698 - protein, 105 aa, Homo sapiens
MTVERDQPLPTPELQMPTMVPSYDLGMAPDSSMSMQLGPDMVPQVYPPHSHSIPPYQGLSPEESVNVLSAFQERSCWAVASPFGSGLMVSWTSPNAVSGATGLTG

SEQ ID NO: 33699 - protein, 8 aa, Homo sapiens
GFPEPLQA

SEQ ID NO: 33700 - protein, 164 aa, Homo sapiens
IQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQERSCWAVASPFGSGLMVSWTSPNAVSGATGLTG

SEQ ID NO: 33701 - protein, 18 aa, Homo sapiens
MVSWTSPNAVSGATGLTG

SEQ ID NO: 33702 - protein, 53 aa, Homo sapiens
ACSLAQIWCPRCTHHTLTPSPRIKASPQKNQSTCCQPSRRDPAGPWLHLLAVV

SEQ ID NO: 33703 - protein, 38 aa, Homo sapiens
MEPWWGCMLLAGRLHSRTCRRTPRLGHSCLTLFMWSVG

SEQ ID NO: 33704 - protein, 24 aa, Homo sapiens
MTTGLCGMGLPSCSATSSGLMGTL

SEQ ID NO: 33705 - protein, 63 aa, Homo sapiens
VASISISCYPCRRSWQILCGRSAATMEPWWGCMLLAGRLHSRTCRRTPRLGHSCLTLFMWSVG

SEQ ID NO: 33706 - protein, 676 aa, Homo sapiens
MEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFK

SEQ ID NO: 33707 - protein, 48 aa, Homo sapiens
VAVEKRVQLRSRNQHSLSMSHLSAQWRYPGKHSRGDGNQIQRRTGCLP

SEQ ID NO: 33708 - protein, 742 aa, Homo sapiens
IAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFK

SEQ ID NO: 33709 - protein, 33 aa, Homo sapiens
LPNSAISVARICPHGALPSGCPLMSLTLCVSGC

SEQ ID NO: 33710 - protein, 505 aa, Homo sapiens
MTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGV

SEQ ID NO: 33711 - protein, 54 aa, Homo sapiens
IFPGESGMKREKMGSLGQRTLSFPAYNCFLVSESQKRCKGAWILPCLSNVTMRR

SEQ ID NO: 33712 - protein, 333 aa, Homo sapiens
MDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33713 - protein, 27 aa, Homo sapiens
ALSLHIRTLIGCLITPLLRIFVLKMNL

SEQ ID NO: 33714 - protein, 17 aa, Homo sapiens
ICEILQSQESALSYPAS

SEQ ID NO: 33715 - protein, 98 aa, Homo sapiens
MEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33716 - protein, 11 aa, Homo sapiens
MKQNLKKKVQA

SEQ ID NO: 33717 - protein, 15 aa, Homo sapiens
ADAVYEDGEAPPEVA

SEQ ID NO: 33718 - protein, 734 aa, Homo sapiens
MKQNLKVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33719 - protein, 60 aa, Homo sapiens
IHHEAESKEKGPSMKEPNPISPPIFHGLDTLTVMGIAFAAFVIGALLTGALWYIYSHTGV

SEQ ID NO: 33720 - protein, 16 aa, Homo sapiens
RNQIQFLHQFSMVWTP

SEQ ID NO: 33721 - protein, 588 aa, Homo sapiens
MSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33722 - protein, 25 aa, Homo sapiens
LPLGSPDCFWCLRVLWSSFHQQTSP

SEQ ID NO: 33723 - protein, 17 aa, Homo sapiens
IGPEKSMEQLLHSPNSR

SEQ ID NO: 33724 - protein, 691 aa, Homo sapiens
ATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33725 - protein, 1125 aa, Homo sapiens
MCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQ

SEQ ID NO: 33726 - protein, 72 aa, Homo sapiens
GAAPTMSAAQIAMVWPLLSILSEWKEICVWSIWMTETLFDIVWWCPMSRLRLALTVPPSTTTTCVTVPAWAA

SEQ ID NO: 33727 - protein, 21 aa, Homo sapiens
LALTVPPSTTTTCVTVPAWAA

SEQ ID NO: 33728 - protein, 51 aa, Homo sapiens
MENISPFSTPLPSTRCFANWPRPALCSCGLIPHPRPAPASAPWPSTSSHST

SEQ ID NO: 33729 - protein, 10 aa, Homo sapiens
LYHHPLQLHV

SEQ ID NO: 33730 - protein, 60 aa, Homo sapiens
MVWPLLSILSEWKEICVWSIWMTETLFDIVWWCPMSRLRLALTVPPSTTTTCVTVPAWAA

SEQ ID NO: 33731 - protein, 179 aa, Homo sapiens
MRPTSHMKTSRPPSTQAPCSTPSGSPCSRTSTQSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVFHQEPADHYRRGLRAAAPAAA

SEQ ID NO: 33732 - protein, 10 aa, Homo sapiens
RSWRRTRPAR

SEQ ID NO: 33733 - protein, 43 aa, Homo sapiens
GHARGAGGGHGPHADRHRAESPALQPAAAQGPGGSPDPAGAAG

SEQ ID NO: 33734 - protein, 120 aa, Homo sapiens
AMLEELEADTARTLTDIEQKVQRYSQQLRKVQEGAQILQERLAETDRHTFLAGVASLSERLKGKIHETNLTYEDFPTSKYTGPLQYTIWKSLFQDIHPVFHQEPADHYRRGLRAAAPAAA

SEQ ID NO: 33735 - protein, 87 aa, Homo sapiens
MLEELEADTARTLTDIEQKVQRYSQQLRKVQEGAQILQERLAETDRHTFLAGVASLSERLPPRACGPLSARPSSGCTGCCVNARRPC

SEQ ID NO: 33736 - protein, 115 aa, Homo sapiens
MKRLEKYLSQMKNRPMCLTSMPLAIYWRIRWSSPQLQSRQEDCWLRGSMQVPLSSVTMKMFQPLYLLLWNMVLVAFLRRKLWRSLGKKILRFTIVTFGHWNGRFRQEITTNVMQK

SEQ ID NO: 33737 - protein, 221 aa, Homo sapiens
MKIKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEN

SEQ ID NO: 33738 - protein, 1868 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVK

SEQ ID NO: 33739 - protein, 149 aa, Homo sapiens
VKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNRTVGPWKERSRNWPRKPICPLCL

SEQ ID NO: 33740 - protein, 36 aa, Homo sapiens
MWTDQKAAGQHNWNPPCLCRGLSGGQTSKATKNERP

SEQ ID NO: 33741 - protein, 9 aa, Homo sapiens
QQMLCKNNL

SEQ ID NO: 33742 - protein, 60 aa, Homo sapiens
TCCGLSRTGSKCWRSYTRLCSCAQMWTDQKAAGQHNWNPPCLCRGLSGGQTSKATKNERP

SEQ ID NO: 33743 - protein, 2533 aa, Homo sapiens
AVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAE

SEQ ID NO: 33744 - protein, 35 aa, Homo sapiens
LWRSLGKKILRFTIVTFGHWNGRFRQEITTNVMQK

SEQ ID NO: 33745 - protein, 11 aa, Homo sapiens
MLNGIQGANIC

SEQ ID NO: 33746 - protein, 23 aa, Homo sapiens
LIGSPVKTLGNNMLNGIQGANIC

SEQ ID NO: 33747 - protein, 26 aa, Homo sapiens
MVSRVQISVRTEGTRIYKQYSFNSFT

SEQ ID NO: 33748 - protein, 9 aa, Homo sapiens
GWTTFMALG

SEQ ID NO: 33749 - protein, 51 aa, Homo sapiens
ILWTGTSSRPMTDCSASSSTYRILPTSTMPPRSCWTGAETHGPSSGPSSRA

SEQ ID NO: 33750 - protein, 11 aa, Homo sapiens
AGQRSWLSGRT

SEQ ID NO: 33751 - protein, 116 aa, Homo sapiens
LDNVHGSRVEPSETARMNSMDRHIQQTNDRLQCIKQHLQNPANFHNAATELLDWCGDPRAFQRPFEQSLMGCLTVVSRVAAQQGFDLDLGYRLLAVCAANRDKFTPKSAGLTAAVF

SEQ ID NO: 33752 - protein, 66 aa, Homo sapiens
MGCLTVVSRVAAQQGFDLDLGYRLLAVCAANRDKFTPKSAAGWSWSEVEGPQAADRRVEHWWFADH

SEQ ID NO: 33753 - protein, 135 aa, Homo sapiens
LDNVHGSRVEPSETARMNSMDRHIQQTNDRLQCIKQHLQNPANFHNAATELLDWCGDPRAFQRPFEQSLMGCLTVVSRVAAQQGFDLDLGYRLLAVCAANRDKFTPKSAAGWSWSEVEGPQAADRRVEHWWFADH

SEQ ID NO: 33754 - protein, 1870 aa, Homo sapiens
MQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSV

SEQ ID NO: 33755 - protein, 29 aa, Homo sapiens
TYFGISGRQAARRSPTEAPSVHHPQGTQW

SEQ ID NO: 33756 - protein, 103 aa, Homo sapiens
TFLTLSCRAMQGGEEMKTTLMIFPDQNWRGRWLSSRLSVKYGRIRTQDFLSQRSIRFIIQETGENLPLPCDLRMKPQPLPRYSTGSITQKSLSSSRVITKLLF

SEQ ID NO: 33757 - protein, 558 aa, Homo sapiens
MEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPIL

SEQ ID NO: 33758 - protein, 11 aa, Homo sapiens
ILWGNICCGFQ

SEQ ID NO: 33759 - protein, 32 aa, Homo sapiens
MEETKEAMSEMLRHPRISGKPILKGDSFDGGT

SEQ ID NO: 33760 - protein, 294 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQVDDVSHCVRESHGDGHSELLMGTWDSSCL

SEQ ID NO: 33761 - protein, 328 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQQNRMHPFRDDRRSKSIEEREEEYQRVRERIFAHDVDDVSHCVRESHGDGHSELLMGTWDSSCL

SEQ ID NO: 33762 - protein, 58 aa, Homo sapiens
MPFTLHLRSRLPSAIRSLILQKKPNIRNTSSMAGDGEGKASDLSRATLSKGDLSPQGC

SEQ ID NO: 33763 - protein, 29 aa, Homo sapiens
KLTSRWHSSSEQGKCNSGPMCDSETRPTN

SEQ ID NO: 33764 - protein, 34 aa, Homo sapiens
RSQVTPCLTLPSKGRLCKILCYLFKLTRCPSHST

SEQ ID NO: 33765 - protein, 35 aa, Homo sapiens
QAGGILLQSRASVILDQCVILRPDQPTEGAKLHPV

SEQ ID NO: 33766 - protein, 794 aa, Homo sapiens
MPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIK

SEQ ID NO: 33767 - protein, 25 aa, Homo sapiens
RTVHLFFIYNACQNFQGISHRSGCS

SEQ ID NO: 33768 - protein, 34 aa, Homo sapiens
LGKTTNPKTASCLLPARSSGRTQLHLSPAGRTWT

SEQ ID NO: 33769 - protein, 48 aa, Homo sapiens
GTRDWERPRIQKQPAVCCQPEVQEEHSSISLQPEEHGPSEVRYQDPRA

SEQ ID NO: 33770 - protein, 225 aa, Homo sapiens
MDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRR

SEQ ID NO: 33771 - protein, 37 aa, Homo sapiens
MRLMRKLNLPQVTWLLPLVTCQLTRSELLLLLCHREW

SEQ ID NO: 33772 - protein, 18 aa, Homo sapiens
IAFLVSPTLTFLLKWLSA

SEQ ID NO: 33773 - protein, 69 aa, Homo sapiens [sequence omitted]

SEQ ID NO: 33774 - protein, 11 aa, Homo sapiens
MLRTSANLSPM

SEQ ID NO: 33775 - protein, 135 aa, Homo sapiens
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEACLFEGPARFRLLLRSCPP

SEQ ID NO: 33776 - protein, 15 aa, Homo sapiens
GRWDSGGASRREAAS

SEQ ID NO: 33777 - protein, 99 aa, Homo sapiens
MKNIMAGLQQTNSEKILLSWVRQSTRNYPQVNVINFTTSWSDGLALNALIHSHRPDLFDWNSVVCQQSATQRLEHAFNIARYQLGIEKLLDPEVWEAAY

SEQ ID NO: 33778 - protein, 8 aa, Homo sapiens
KDPQEFMP

SEQ ID NO: 33779 - protein, 21 aa, Homo sapiens
RIHKSSCPEQCQQGTAGFAEQ

SEQ ID NO: 33780 - protein, 869 aa, Homo sapiens
MAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAG

SEQ ID NO: 33781 - protein, 927 aa, Homo sapiens
LARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAG

SEQ ID NO: 33782 - protein, 26 aa, Homo sapiens
GSESLGCDPALRSKMDKQRSEPWSLS

SEQ ID NO: 33783 - protein, 19 aa, Homo sapiens
MSYFGEHFWMGKLRHGAGQ

SEQ ID NO: 33784 - protein, 39 aa, Homo sapiens
LCDLDRHWTGPAGVSTETIRMSYFGEHFWMGKLRHGAGQ

SEQ ID NO: 33785 - protein, 17 aa, Homo sapiens
GTELDSDSDTRSCLEWS

SEQ ID NO: 33786 - protein, 10 aa, Homo sapiens
MEMWSLVTNL

SEQ ID NO: 33787 - protein, 25 aa, Homo sapiens
LQNWDVELEVPPLLGCAGHSHTLHR

SEQ ID NO: 33788 - protein, 57 aa, Homo sapiens
LKRRIELTVEYPWRCGALSPTSNCRTGMWSWKCLLFWAVLVTATLCTARPSPTLPEQ

SEQ ID NO: 33789 - protein, 1395 aa, Homo sapiens
MTGAEIESGAQVKPEKKPGEEVVGGAEIENDVPLVVRPKVRTQAQIMPGARPKNKSKVMPGASTKVETSAVGGARPKSKAKAIPVSRFKEEAQMWAQPRFGAERLSKTERNSQTNIIASPLVSTDSVLVAKTKYLSEDRELVNTDTESFPRRKAHYQAGFQPSFRSKEETNMGSWCCPRPTSKQEASPNSDFKWVDKSVSSLFWSGDEVTAKFHPGNRVKDSNRSMHMANQEANTMSRSQTNQELYIASSSGSEDESVKTPWFWARDKTNTWSGPREDPNSRSRFRSKKEVYVESSSGSEHEDHLESWFGAGKEAKFRSKMRAGKEANNRARHRAKREACIDFMPGSIDVIKKESCFWPEENANTFSRPMIKKEARARAMTKEEAKTKARARAKQEARSEEEALIGTWFWATDESSMADEASIESSLQVEDESIIGSWFWTEEEASMGTGASSKSRPRTDGERIGDSLFGAREKTSMKTGAEATSESILAADDEQVIIGSWFWAGEEVNQEAEEETIFGSWFWVIDAASVESGVGVSCESRTRSEEEEVIGPWFWSGEQVDIEAGIGEEARPGAEEETIFGSWFWAENQTYMDCRAETSCDTMQGAEEEEPIIGSWFWTRVEACVEGDVNSKSSLEDKEEAMIPCFGAKEEVSMKHGTGVRCRFMAGAEETNNKSCFWAEKEPCMYPAGGGSWKSRPEEEEDIVNSWFWSRKYTKPEAIIGSWLWATEESNIDGTGEKAKLLTEEETIINSWFWKEDEAISEATDREESRPEAEEGDIIGSWFWAGEEDRLEPAAETREEDRLAAEKEGIVGSWFGAREETIRREAGSCSKSSPKAEEEEVIIGSWFWEEEASPEAVAGVGFESKPGTEEEEITVGSWFWPEEEASIQAGSQAVEEMESETEEETIFGSWFWDGKEVSEEAGPCCVSKPEDDEEMIVESWFWSRDKAIKETGTVATCESKPENEEGAIVGSWFEAEDEVDNRTDNGSNCGSRTLADEDEAIVGSWFWAGDEAHFESNPSPVFRAICRSTCSVEQEPDPSRRPQSWEEVTVQFKPGPWGRVGFPSISPFRFPKEAASLFCEMFGGKPRNMVLSPEGEDQESLLQPDQPSPEFPFQYDPSYRSVQEIREHLRAKESTEPESSSCNCIQCELKIGSEEFEELLLLMEKIRDPFIHEISKIAMGMRSASQFTRDFIRDSGVVSLIETLLNYPSSRVRTSFLENMIRMAPPYPNLNIIQTYICKVCEETLAYSVDSPEQLSGIRMIRHLTTTTDYHTLVANYMSGFLSLLATGNAKTRFHVLKMLLNLSENLFMTKELLSAEAVSEFIGLFNREETNDNIQIVLAIFENIGNNIKKETVFSDDDFNIEPLISAFHKVEKFAKELQGKTDNQNDPEGDQEN

SEQ ID NO: 33790 - protein, 25 aa, Homo sapiens
VTTGLDIDSNSCFQAYILNHLKIRV

SEQ ID NO: 33791 - protein, 21 aa, Homo sapiens
LGQRLSLVPRSSLKRSLGKRL

SEQ ID NO: 33792 - protein, 35 aa, Homo sapiens
KQEKGAGLRTPPFYAWIRRMIFYMFTTSSLREPPP

SEQ ID NO: 33793 - protein, 15 aa, Homo sapiens
RQLLTYYMKRKWKCR

SEQ ID NO: 33794 - protein, 396 aa, Homo sapiens
MPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRHPSYQCP

SEQ ID NO: 33795 - protein, 195 aa, Homo sapiens
MMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTVSGIT

SEQ ID NO: 33796 - protein, 8 aa, Homo sapiens
KTVSYDFL

SEQ ID NO: 33797 - protein, 1739 aa, Homo sapiens
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGRRA

SEQ ID NO: 33798 - protein, 1748 aa, Homo sapiens
IASEVFVKVMDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGRRA

SEQ ID NO: 33799 - protein, 9 aa, Homo sapiens
MQPALTLPE

SEQ ID NO: 33800 - protein, 22 aa, Homo sapiens
RSWILNKVSRAPRRLREVPGSG

SEQ ID NO: 33801 - protein, 13 aa, Homo sapiens
KKSLRSEAPFFVS

SEQ ID NO: 33802 - protein, 16 aa, Homo sapiens
QRHQENLMELKSIFSP

SEQ ID NO: 33803 - protein, 470 aa, Homo sapiens
MKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQAT

SEQ ID NO: 33804 - protein, 654 aa, Homo sapiens
KQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNE

SEQ ID NO: 33805 - protein, 949 aa, Homo sapiens
MERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEA

SEQ ID NO: 33806 - protein, 8 aa, Homo sapiens
MGTRCFLC

SEQ ID NO: 33807 - protein, 308 aa, Homo sapiens
MGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAICL

SEQ ID NO: 33808 - protein, 15 aa, Homo sapiens
GRLASSSCCCCWICL

SEQ ID NO: 33809 - protein, 47 aa, Homo sapiens
MLLQLPPLPPWAVLAAPLPPLPALPFILPQSPTARLCKWRAAPQPWG

SEQ ID NO: 33810 - protein, 12 aa, Homo sapiens
QPERMPHKGGRL

SEQ ID NO: 33811 - protein, 70 aa, Homo sapiens
RGKTLTRGAQMCEAFYCESGQTSEISEPHIRAPWNPAAPSQSQHAEQNLRIALTHQPSNIRGENSHQQLL

SEQ ID NO: 33812 - protein, 9 aa, Homo sapiens
IPQEKGRWI

SEQ ID NO: 33813 - protein, 28 aa, Homo sapiens
AERPASQSPGDFILRSRHSNTTGKMGRC

SEQ ID NO: 33814 - protein, 2689 aa, Homo sapiens
MAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPE

SEQ ID NO: 33815 - protein, 447 aa, Homo sapiens
MDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRR

SEQ ID NO: 33816 - protein, 47 aa, Homo sapiens
RWRRTWKLTGTVPREIPCSPPALWRPMTPPCPLHPPRPRGRPSRAIC

SEQ ID NO: 33817 - protein, 600 aa, Homo sapiens
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEGKTMNYGIS

SEQ ID NO: 33818 - protein, 17 aa, Homo sapiens
ALLLSKQPWFTYWDFET

SEQ ID NO: 33819 - protein, 28 aa, Homo sapiens
MIFSDMNTVSGSPKVHPPNGTRFYTFQA

SEQ ID NO: 33820 - protein, 51 aa, Homo sapiens
KNNSKCYHCVCKKDGADFILPSSLPQCMHGFICTLSSLLCICSSLWIILSQ

SEQ ID NO: 33821 - protein, 19 aa, Homo sapiens
ALCSASVAPCGLYCLSDQK

SEQ ID NO: 33822 - protein, 32 aa, Homo sapiens
GLPDLGHIDLVLAIDWQHGSSQLQSHQGAASF

SEQ ID NO: 33823 - protein, 25 aa, Homo sapiens
IWFWPLTGNMAVANCRATREQPHSD

SEQ ID NO: 33824 - protein, 20 aa, Homo sapiens
RHIEENQLPKLLAAALLRPA

SEQ ID NO: 33825 - protein, 226 aa, Homo sapiens
LSITKTLMGKRDTADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFTPGRIQKCPGCPVVMGMAGTCIFVSSCT

SEQ ID NO: 33826 - protein, 66 aa, Homo sapiens
MELKVWVDGVQRIVCGVTEVTTCQEVVIALAQAIGACVDHPRIPVWCCPSSRLPHSHWLGDSCLLS

SEQ ID NO: 33827 - protein, 72 aa, Homo sapiens
VTGRCTMELKVWVDGVQRIVCGVTEVTTCQEVVIALAQAIGACVDHPRIPVWCCPSSRLPHSHWLGDSCLLS

SEQ ID NO: 33828 - protein, 22 aa, Homo sapiens
VWCCPSSRLPHSHWLGDSCLLS

SEQ ID NO: 33829 - protein, 32 aa, Homo sapiens
LAGAPWNLKYGWMEFRGLFVESLKSQLARRLS

SEQ ID NO: 33830 - protein, 15 aa, Homo sapiens
ADYTDLVFSTPCSCS

SEQ ID NO: 33831 - protein, 2789 aa, Homo sapiens
MKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSK

SEQ ID NO: 33832 - protein, 16 aa, Homo sapiens
KSNIIHEIRTRFSCVP

SEQ ID NO: 33833 - protein, 247 aa, Homo sapiens
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVTTVSHNWTVWNCTSLLFQTSIRVLVWLLGLLYFSSLPLGIYLLVSKKVTLGVVFVSLVPSSLVILMVYGFCQCVCHEFLDCMAPPS

SEQ ID NO: 33834 - protein, 1037 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQ

SEQ ID NO: 33835 - protein, 1095 aa, Homo sapiens
VRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQ

SEQ ID NO: 33836 - protein, 25 aa, Homo sapiens
MGYKLQDLTDVQIMARLQEESMCSF

SEQ ID NO: 33837 - protein, 19 aa, Homo sapiens
KRRNWKCMSVFWLRLGKAA

SEQ ID NO: 33838 - protein, 8 aa, Homo sapiens
AEYFRIGG

SEQ ID NO: 33839 - protein, 391 aa, Homo sapiens
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSGTSFVAGFAIFSILGFMSQEQGVPISEVAESGECYWGGLEAVSLVQTSGSKRLEAFPLCHLHSG

SEQ ID NO: 33840 - protein, 13 aa, Homo sapiens
ADHRSRCWGLRET

SEQ ID NO: 33841 - protein, 9 aa, Homo sapiens
LTTGAGAGD

SEQ ID NO: 33842 - protein, 283 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRERKLLKLLKYLLLYSKKLKCPEICL

SEQ ID NO: 33843 - protein, 9 aa, Homo sapiens
LELLLRTCV

SEQ ID NO: 33844 - protein, 21 aa, Homo sapiens
KKHMALVKINVTPPFLIGTSA

SEQ ID NO: 33845 - protein, 213 aa, Homo sapiens
MRTSAEYFRLALSKLQSCDLFDEFDKMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 33846 - protein, 14 aa, Homo sapiens
TTTAMCPTSWRQSR

SEQ ID NO: 33847 - protein, 29 aa, Homo sapiens
AAEDHLRGGHHPHRVCLPQAGQGLPRLSR

SEQ ID NO: 33848 - protein, 668 aa, Homo sapiens
MIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFD

SEQ ID NO: 33849 - protein, 20 aa, Homo sapiens
LQSQARLCLPARQTPSRTRR

SEQ ID NO: 33850 - protein, 67 aa, Homo sapiens
QNFHREAIFNRNEGFHGYLGSPRNKSSSWLCNCSLRQGSAFQPARRPPGRGDDRRQHGGHPRGLRRS

SEQ ID NO: 33851 - protein, 2489 aa, Homo sapiens
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVK

SEQ ID NO: 33852 - protein, 84 aa, Homo sapiens
QLPLRPSLASSCGRPCSSHATSPGLGWAKCDVMRAGTRHPGAAWTEDCGRAALGIYLHAPALLQLPQRAALHRAHPLHRAHLRL

SEQ ID NO: 33853 - protein, 291 aa, Homo sapiens
MHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQARVSHGATCGEQVPPGTEDRERVLRRYLPG

SEQ ID NO: 33854 - protein, 2099 aa, Homo sapiens
VGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFK

SEQ ID NO: 33855 - protein, 84 aa, Homo sapiens
MDSSQQKTFRGHDAPVLSLSFDPKDIFLASASCDGSVRVWQISDQTCAISWPLLQKCNDVINAKSICRLAWQPKSGKFYCDLWK

SEQ ID NO: 33856 - protein, 19 aa, Homo sapiens
RSSRWYIDSLHYKCKPCGL

SEQ ID NO: 33857 - protein, 135 aa, Homo sapiens
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQGMNLKSAAVKHRRL

SEQ ID NO: 33858 - protein, 10 aa, Homo sapiens
LLMRIGKAES

SEQ ID NO: 33859 - protein, 873 aa, Homo sapiens
MASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 33860 - protein, 11 aa, Homo sapiens
LHHEKAANETC

SEQ ID NO: 33861 - protein, 8 aa, Homo sapiens
ASMLFNHH

SEQ ID NO: 33862 - protein, 880 aa, Homo sapiens
AFPHNIRMASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 33863 - protein, 81 aa, Homo sapiens
MDVFVDFTWEEWQLLDPAQKCLYRSVMLENYSNLVSLGYQHTKPDIIFKLEQGEELCMVQAQVPNQTCPSPTSPRTKQFMG

SEQ ID NO: 33864 - protein, 516 aa, Homo sapiens
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCSERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVCGKVFHHISHLAQHQRIHTGEKPYKCNECGKVFSHKSSLVNHWRIHTGEKPYKCNECGKVFSHKSSLVNHWRIHTGEKPYKCNECGKVFSRNSYLAQHLIIHAGEKPYKCDECDKAFSQNSHLVQHHRIHTGEKPYKCDECGKVFSQNSYLAYHWRIHTGEKAYKCNECGKVFGLNSSLAHHRKIHTGEKPFKCNECGKAFSMRSSLTNHHAIHTGEKHFKCNECGKLFRDNSYLVRHQRFHAGKKSNTCN

SEQ ID NO: 33865 - protein, 17 aa, Homo sapiens
KPRHTRFLLQRNPEKCT

SEQ ID NO: 33866 - protein, 8 aa, Homo sapiens
KRHAWEKG

SEQ ID NO: 33867 - protein, 77 aa, Homo sapiens
MKPSSSSTHFLLDPMPRNMESFKHKCQPDIYFFYNCQYSSSSSSQHLKPGLSHLYYSWSESVPGLLPQLQLWSHRSD

SEQ ID NO: 33868 - protein, 25 aa, Homo sapiens
ACTCSTETFLWRPFYKSIFVPDYTK

SEQ ID NO: 33869 - protein, 8 aa, Homo sapiens
QEPGQEES

SEQ ID NO: 33870 - protein, 10 aa, Homo sapiens
IRTGISVGLG

SEQ ID NO: 33871 - protein, 35 aa, Homo sapiens
LHLQHRDFPLETLLQVHLCPRLHQVKILMISPGKT

SEQ ID NO: 33872 - protein, 10 aa, Homo sapiens
MRDTYFSLMA

SEQ ID NO: 33873 - protein, 11 aa, Homo sapiens
VNLHVGFIVSK

SEQ ID NO: 33874 - protein, 22 aa, Homo sapiens
TRFRRILMVGREKTLDSVVMNL

SEQ ID NO: 33875 - protein, 14 aa, Homo sapiens
IYNGRNSYTCRSQT

SEQ ID NO: 33876 - protein, 10 aa, Homo sapiens
MPVLETTPST

SEQ ID NO: 33877 - protein, 24 aa, Homo sapiens
MSLCYMTLKIFRHPRIPLCIKLAC

SEQ ID NO: 33878 - protein, 21 aa, Homo sapiens
MDHCQMVWKTLLLLLYFNPVK

SEQ ID NO: 33879 - protein, 16 aa, Homo sapiens
KQSRISCDQTRPDFCL

SEQ ID NO: 33880 - protein, 25 aa, Homo sapiens
IRTQQRILRKKDLCFLQKITLKTAY

SEQ ID NO: 33881 - protein, 21 aa, Homo sapiens
VCSSTQLVSIPIFQPRYSKTR

SEQ ID NO: 33882 - protein, 14 aa, Homo sapiens
ITSNQRKSWWQQIL

SEQ ID NO: 33883 - protein, 40 aa, Homo sapiens
MAGLPRRSCPRAARRYARRRHPLNHVGRTQRSAMQLSVSP

SEQ ID NO: 33884 - protein, 868 aa, Homo sapiens
VLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQTQESLNPNNLEYWMEDIYTPGYDSLLKRKEAEFRRAKVCKIAALIAAAACTVILVIVVPICTMKS

SEQ ID NO: 33885 - protein, 30 aa, Homo sapiens
MPRLLVSLKTRKICCQSLDNSYQMPTAPCF

SEQ ID NO: 33886 - protein, 66 aa, Homo sapiens
QSRWERPHPCRTINLWSLIMPSTMLIRSRTDFRANQTSTKHSWRFCTHIRKSREMPRKLEETTLQH

SEQ ID NO: 33887 - protein, 13 aa, Homo sapiens
IRDGHHESEIWTI

SEQ ID NO: 33888 - protein, 3192 aa, Homo sapiens
ADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIK

SEQ ID NO: 33889 - protein, 14 aa, Homo sapiens
AMCLRTSARTAGRM

SEQ ID NO: 33890 - protein, 31 aa, Homo sapiens
MNNSMVNCQMDDIKFPSHSSQSFPPRCSLDP

SEQ ID NO: 33891 - protein, 32 aa, Homo sapiens
MKMSSKSLSTITSGPSSRPSCFSSVLWGFCCL

SEQ ID NO: 33892 - protein, 125 aa, Homo sapiens
INLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSMGLLLLMKMPCGCSTSSSPPSSLWNVC

SEQ ID NO: 33893 - protein, 40 aa, Homo sapiens
AFSASSELPGSSNFSVRVTPSAFFSGPLCSPSRPCLMSVC

SEQ ID NO: 33894 - protein, 60 aa, Homo sapiens
QPELSPPLPSCPAHQTSPSGLHHPHSSLDLCAVLQGPALCLSADRHALLHLCHHWDAGVW

SEQ ID NO: 33895 - protein, 44 aa, Homo sapiens
MDLPVADDNTVHFNSTLMALIRTALDIKIAKDAESLCRRHHGQL

SEQ ID NO: 33896 - protein, 27 aa, Homo sapiens
MALIRTALDIKIAKDAESLCRRHHGQL

SEQ ID NO: 33897 - protein, 25 aa, Homo sapiens
QHRPLQFHPHGSDPHSPGHQDCQGC

SEQ ID NO: 33898 - protein, 137 aa, Homo sapiens
MVQAIKWVDEVVPAAPYVTTLETLDKYNCDFCVHGNDITLTVDGRDTYEEVKQAGRYSYDMVHYGHSNQLRQARAMGDYLIVGVHTDAKEKGHLLPTTASEAPKPSGAEHLLVRRNLCLCLRPSQGREPPSWPALVG

SEQ ID NO: 33899 - protein, 39 aa, Homo sapiens
RRSPSTRGPRCSLRRRDTRWCRPSNGWTRWCQRLPTSLH

SEQ ID NO: 33900 - protein, 27 aa, Homo sapiens
MRMMKTWRMNQFTPAITVSRTSSLWQT

SEQ ID NO: 33901 - protein, 19 aa, Homo sapiens
KESQSAIRKPAVRWKTGTA

SEQ ID NO: 33902 - protein, 328 aa, Homo sapiens
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKGQFEKEDRAHCGVSMEMWSLVTNL

SEQ ID NO: 33903 - protein, 36 aa, Homo sapiens
MITLSVLHIPLWAHFMDSLCVLVKCAVLLPRPCKAY

SEQ ID NO: 33904 - protein, 34 aa, Homo sapiens
VSSTFLCGLTSWTHFACLLNVLCCSQDHVKPTDH

SEQ ID NO: 33905 - protein, 24 aa, Homo sapiens
MNDYTKCPPHSSVGSLHGLTLRAC

SEQ ID NO: 33906 - protein, 9 aa, Homo sapiens
MCCVAPKTM

SEQ ID NO: 33907 - protein, 1049 aa, Homo sapiens
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQIFDSSGSHGFSGTQLPQNSSNSSEVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANGLCV

SEQ ID NO: 33908 - protein, 25 aa, Homo sapiens
MCRARCFWRHASHTLHGKLGRWTYY

SEQ ID NO: 33909 - protein, 64 aa, Homo sapiens
ASRPAPSRPVWPGRRGNAVLAAATRTACPGAPAPCPAPSHDPAPLTPPAPSAAAAAAQCGGVPG

SEQ ID NO: 33910 - protein, 17 aa, Homo sapiens
ILRSILKTLHGQRIVMM

SEQ ID NO: 33911 - protein, 159 aa, Homo sapiens
MAQHDFAPAWLNFPTPPSSTKVLTSSLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFNYAAGQGMDAGREKR

SEQ ID NO: 33912 - protein, 11 aa, Homo sapiens
KILTVSCNRLK

SEQ ID NO: 33913 - protein, 10 aa, Homo sapiens
ILTVSCNRLK

SEQ ID NO: 33914 - protein, 9 aa, Homo sapiens
KILTVSCNR

SEQ ID NO: 33915 - protein, 9 aa, Homo sapiens
LTVSCNRLK

SEQ ID NO: 33916 - protein, 10 aa, Homo sapiens
IRTGISVGLG

SEQ ID NO: 33917 - protein, 9 aa, Homo sapiens
KILTVSRLK

SEQ ID NO: 33918 - protein, 9 aa, Homo sapiens
KILTVSNRL

SEQ ID NO: 33919 - protein, 10 aa, Homo sapiens
KILTVSCNRL

SEQ ID NO: 33920 - protein, 9 aa, Homo sapiens
KTVSCNRLK

SEQ ID NO: 33921 - protein, 9 aa, Homo sapiens
ILVSCNRLK

SEQ ID NO: 33922 - protein, 9 aa, Homo sapiens
ILTVSNRLK

SEQ ID NO: 33923 - protein, 9 aa, Homo sapiens
ILTVSCNRL

SEQ ID NO: 33924 - protein, 9 aa, Homo sapiens
IRTGISVGL

SEQ ID NO: 33925 - DNA, 174 bp, Unknown
  circlRES 6742
agactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccag

SEQ ID NO: 33926 - DNA, 174 bp, Unknown
  linearlRES 6885
atttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcac

SEQ ID NO: 33927 - DNA, 174 bp, Unknown
  circlRES - Dis
agactcgggaactgcctgaatgtggtttgggacacgttctttttctcactatctgaaaatacaaacaagaacatttcctccctcccctcctttgaattgaaatggcacattaagacttgtcacggcttctcactgggactggagacctcgttccttcaccccgcgtgtcgccag

SEQ ID NO: 33928 - DNA, 174 bp, Unknown
  circlRES - Relocate
agactcgggaactgcctgaatgtggtttgggacacgttctttttctcactatctgaaaatacaaagacctcatcatattgatgagcgaactttgaattgaaatggcacattaagacttgtcacggcttctcactgggactggagacctcgttccttcaccccgcgtgtcgccag

SEQ ID NO: 33929 - DNA, 174 bp, Unknown
  circlRES - Single
agactcgggaactgcctgaatgtggtttgggacacgagacgagtagttattgatgagcgaacaaacaagaacatttcctccctcccctcctttgaattgaaatggcacattaagacttgtcacggcttctcactgggactggagacctcgttccttcaccccgcgtgtcgccag

SEQ ID NO: 33930 - DNA, 174 bp, Unknown
  circlRES - Comp
agactcgggaactgcctgaatgtggtttgggacacgagacgagtagttatactactccgaacaaacaagaacatttcctccctcccctcctttgaattgaaatggcacattaagacttgtcacggcttctcactgggactggagacctcgttccttcaccccgcgtgtcgccag

SEQ ID NO: 33931 - DNA, 174 bp, Unknown
  circlRES - BoxB
agactcgggaactgcctgaatgtggtttgggacacgagagggccctgaagaagggcccgaacaaacaagaacatttcctccctcccctcctttgaattgaaatggcacattaagacttgtcacggcttctcactgggactggagacctcgttccttcaccccgcgtgtcgccag

SEQ ID NO: 33932 - DNA, 174 bp, Unknown
  linearlRES - Add
atttatgatttcaacatggatacatatttcagttctagacctcatcatattgatgagcgaacatttccctccctctcttccccccaatatctccctttttttctctcttcctctatcttccaaaccccactttctccctcctccttttcctgtgttctcttaagcagatagcac

SEQ ID NO: 33933 - protein, 20 aa, Homo sapiens
QVYTSGKGSSAAGLTASVMR

SEQ ID NO: 33934 - protein, 18 aa, Homo sapiens
IFTPAVSAVYSTVTQVAR

SEQ ID NO: 33935 - protein, 40 aa, Artificial Sequence
  junction of circFGFR1 construct
CTTATGTCCAGATCTTGAAGGGTCAGTTTGAAAAGGAGGA

SEQ ID NO: 33936 - protein, 8 aa, Homo sapiens
GQFEKEDR

SEQ ID NO: 33937 - protein, 16 aa, Homo sapiens
AHCGVSMEMWSLVTNL

SEQ ID NO: 33938 - DNA, 174 bp, Unknown
  circlRES:18377
agtacagggcagtcgtcaacagttcaacacgcagaataggtttgcgtcttgatatgctgtgtggacgagggcatgcccacggtacatcttaacctatccgggggtcggataggcgaaagtccagtattggactgggagtacagcctgatagggtgttgcagagacccatctgat

SEQ ID NO: 33939 - DNA, 174 bp, Unknown
  circlRES:19420
tggttgaatgagatgcaaaaaattaggaaggacattgacctgtggaaaccttcagcaggtcattgcaactgggaggaagtagagttctgttccaaccactttcacaagcttgttatgagagatgggagaaccttggttgttccttgcagacatgaagttgagcttgtggggcgt

SEQ ID NO: 33940 - DNA, 174 bp, Unknown
  circlRES:9128
agtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaaac

SEQ ID NO: 33941 - DNA, 174 bp, Unknown
  linlRES:6527
gttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagca

SEQ ID NO: 33942 - DNA, 174 bp, Unknown
  linlRES:5471
tcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgtagtga

SEQ ID NO: 33943 - DNA, 174 bp, Unknown
  linlRES:6103
ggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatcta

SEQ ID NO: 33944 - RNA, 5 nt, Unknown
  m6A motif
rrach

SEQ ID NO: 33945 - DNA, 7 bp, Unknown
  Kozak sequence
accatgg

SEQ ID NO: 33946 - DNA, 174 bp, Unknown
  internal ribosome entry sequence
catcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaa

SEQ ID NO: 33947 - DNA, 174 bp, Unknown
  internal ribosome entry sequence
gcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggc

SEQ ID NO: 33948 - DNA, 174 bp, Unknown; identical to SEQ ID NO: 33925
  internal ribosome entry sequence

SEQ ID NO: 33949 - DNA, 174 bp, Unknown
  internal ribosome entry sequence
aggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccata

SEQ ID NO: 33950 - DNA, 174 bp, Unknown
  internal ribosome entry sequence
ggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgc

SEQ ID NO: 33951 - DNA, 174 bp, Unknown
  internal ribosome entry sequence
atttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaacc

SEQ ID NO: 33952 - DNA, 174 bp, Unknown
  internal ribosome entry sequence
tcttttggtgcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcagggg

SEQ ID NO: 33953 - DNA, 174 bp, Unknown
  internal ribosome entry sequence
atccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacaca

SEQ ID NO: 33954 - DNA, 174 bp, Unknown
  internal ribosome entry sequence
cagattagaggacgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaa

SEQ ID NO: 33955 - DNA, 174 bp, Unknown
  internal ribosome entry sequence
ctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgt

SEQ ID NO: 33956 - DNA, 174 bp, Unknown
  internal ribosome entry sequence
agtctggctgcggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcag

SEQ ID NO: 33957 - DNA, 174 bp, Unknown
  internal ribosome entry sequence
atctgcctcagcctctttgtcactgcctggaccattgtccctgctgtttctcagacagcatagaggctgaggctggggccaggacccagacagagacacacggtcactgcagctgaagccgctgcccctgctacaggcaccaccaggaccagctgatcattccagcccacagca

SEQ ID NO: 33958 - DNA, 174 bp, Unknown
  internal ribosome entry sequence
ctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagc

SEQ ID NO: 33959 - DNA, 174 bp, Unknown
  internal ribosome entry sequence
ctcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagt

SEQ ID NO: 33960 - DNA, 174 bp, Unknown
  internal ribosome entry sequence
gcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctga

SEQ ID NO: 33961 - DNA, 174 bp, Unknown
  internal ribosome entry sequence
ctggagggccgcactcccgttccagccaggctgagccttctgtcccctgcctctggggcctgggaaccccccttcttctttctcctgaatggcacccccgccctagaatccagacaccgagtttcccactgtggctggttcaaggagctccctggtgacagtctgtggctgagc

SEQ ID NO: 33962 - DNA, 174 bp, Unknown
  internal ribosome entry sequence
tagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattact

SEQ ID NO: 33963 - DNA, 174 bp, Unknown
  internal ribosome entry sequence
agcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcagg

SEQ ID NO: 33964 - DNA, 174 bp, Unknown
  internal ribosome entry sequence
aagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattg

SEQ ID NO: 33965 - DNA, 174 bp, Unknown
  internal ribosome entry sequence
gcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaaga

SEQ ID NO: 33966 - DNA, 174 bp, Unknown
  internal ribosome entry sequence
aggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacctaccggggcatcgttgattgc

SEQ ID NO: 33967 - DNA, 174 bp, Unknown
  internal ribosome entry sequence
ctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccacc

SEQ ID NO: 33968 - DNA, 174 bp, Unknown
  internal ribosome entry sequence
ctcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagac

SEQ ID NO: 33969 - DNA, 174 bp, Unknown
  internal ribosome entry sequence
ctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaa

SEQ ID NO: 33970 - DNA, 174 bp, Unknown
  internal ribosome entry sequence
gccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcag

SEQ ID NO: 33971 - DNA, 174 bp, Unknown
  internal ribosome entry sequence
tcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtggg

SEQ ID NO: 33972 - DNA, 174 bp, Unknown
  internal ribosome entry sequence
aagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgc

SEQ ID NO: 33973 - DNA, 174 bp, Unknown
  internal ribosome entry sequence
agccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctac

SEQ ID NO: 33974 - DNA, 174 bp, Unknown
  internal ribosome entry sequence
tttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgt

SEQ ID NO: 33975 - DNA, 174 bp, Unknown
  internal ribosome entry sequence
agccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagtta

SEQ ID NO: 33976 - DNA, 174 bp, Unknown
  internal ribosome entry sequence
gggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggagg

SEQ ID NO: 33977 - DNA, 174 bp, Unknown
  internal ribosome entry sequence
ctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttt

SEQ ID NO: 33978 - DNA, 174 bp, Unknown
  internal ribosome entry sequence
caccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcagg

SEQ ID NO: 33979 - DNA, 174 bp, Unknown
  internal ribosome entry sequence
cctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaag

SEQ ID NO: 33980 - DNA, 174 bp, Unknown
  internal ribosome entry sequence
tttagtgtcacaggagacacgagggcaaagtgctgaggaaactctagagcaacatcggaatgcatggtgaagcatcagatggtgaaggagaaggagacacagaagtgatgcagcaggagacagttccagttcctgtaccttcagagaaaaccaaacagcctaaagaatgttttt

SEQ ID NO: 33981 - DNA, 174 bp, Unknown
  internal ribosome entry sequence
gccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagca

SEQ ID NO: 33982 - DNA, 174 bp, Unknown
  internal ribosome entry sequence
cttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatg

SEQ ID NO: 33983 - DNA, 174 bp, Unknown
  internal ribosome entry sequence
caccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctg

SEQ ID NO: 33984 - DNA, 174 bp, Unknown
  internal ribosome entry sequence
gggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacaccc

SEQ ID NO: 33985 - DNA, 174 bp, Unknown
  internal ribosome entry sequence
caccgtagtgcttagaggccgaaaaagtacagccccttccgggctccgcggtacgggaagacagctttgggatgtcggaagatcctagaggtcccaaggtaccacgaaaggcagtggtagaaaagccagctcgggcagcagagcgagaggcccgggccctgctggagaagaacc

SEQ ID NO: 33986 - DNA, 174 bp, Unknown
  internal ribosome entry sequence
attggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacat

SEQ ID NO: 33987 - DNA, 174 bp, Unknown
  internal ribosome entry sequence
acaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgaca

SEQ ID NO: 33988 - DNA, 174 bp, Unknown
  internal ribosome entry sequence
gaggaaggagagagtggaggaggagggctttgggttagggagagtgctttcgtttgttttaaatgggagaaactggagcatgttgccaagggcagagagccagcagagaggggtgaatggaagaaggagcgagaagggggttactgacgaagccttatcctggaggagagaagg

SEQ ID NO: 33989 - DNA, 174 bp, Unknown
  internal ribosome entry sequence
caagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcct

SEQ ID NO: 33990 - DNA, 174 bp, Unknown
  internal ribosome entry sequence
ctagaccaaagggtgcggctgctgcagaggtggctgatgcaggtttccatccttggggaatgaccacgcaactgggcccagccctggtgctgggggtggccctgtgcctgggttgtggccagcccctaccacaggtccctgaacgccccttctctgtgctgtggaatgtaccct

SEQ ID NO: 33991 - DNA, 174 bp, Unknown
  internal ribosome entry sequence
atctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagat

SEQ ID NO: 33992 - DNA, 174 bp, Unknown
  internal ribosome entry sequence
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcg

SEQ ID NO: 33993 - DNA, 174 bp, Unknown
  internal ribosome entry sequence
cacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcct

SEQ ID NO: 33994 - DNA, 174 bp, Unknown
  internal ribosome entry sequence
cctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaact

SEQ ID NO: 33995 - DNA, 174 bp, Unknown
  internal ribosome entry sequence
ttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcagg

SEQ ID NO: 33996 - DNA, 174 bp, Unknown
  internal ribosome entry sequence
ctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcacc

SEQ ID NO: 33997 - DNA, 174 bp, Unknown
  internal ribosome entry sequence
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgc

SEQ ID NO: 33998 - DNA, 174 bp, Unknown
  internal ribosome entry sequence
tgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtg

SEQ ID NO: 33999 - DNA, 174 bp, Unknown
  internal ribosome entry sequence
tgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagc

SEQ ID NO: 34000 - DNA, 174 bp, Unknown
  internal ribosome entry sequence
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttatt

SEQ ID NO: 34001 - DNA, 174 bp, Unknown
  internal ribosome entry sequence
aaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaac

SEQ ID NO: 34002 - DNA, 174 bp, Unknown
  internal ribosome entry sequence
ctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagct

SEQ ID NO: 34003 - DNA, 174 bp, Unknown
  internal ribosome entry sequence
ccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctc

SEQ ID NO: 34004 - DNA, 174 bp, Unknown
  internal ribosome entry sequence
tctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaacc

SEQ ID NO: 34005 - DNA, 174 bp, Unknown
  internal ribosome entry sequence
agttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccg

SEQ ID NO: 34006 - DNA, 174 bp, Unknown
  internal ribosome entry sequence
atcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtgg

SEQ ID NO: 34007 - DNA, 174 bp, Unknown
  internal ribosome entry sequence
atccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacac

SEQ ID NO: 34008 - DNA, 174 bp, Unknown
  internal ribosome entry sequence
caacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccgg

SEQ ID NO: 34009 - DNA, 174 bp, Unknown
  internal ribosome entry sequence
tggctgacacattcctggagcacatgtgccgcctggacattgattcaccacccatcacagcccggaacactggcatcatctgtaccattggcccagcttcccgatcagtggagctgaagaagggagccactctcaaaatcacgctggataacgcctacatggaaaagtgtgacg

SEQ ID NO: 34010 - DNA, 174 bp, Unknown
  internal ribosome entry sequence
gacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgca

SEQ ID NO: 34011 - DNA, 174 bp, Unknown
  internal ribosome entry sequence
cctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaa

SEQ ID NO: 34012 - DNA, 174 bp, Unknown
  internal ribosome entry sequence
cttccctgaggaggacgaccccaccaactggctgcgttgctactactacgaagacaccatcagcaccatcaagtctgtggcctgggagggaggggcctgtccagccttcctgccatccctacgaccactgcccctcacatcaccttctcatgggtccctctcccactccaaagc

SEQ ID NO: 34013 - DNA, 174 bp, Unknown; identical to SEQ ID NO: 33926
  internal ribosome entry sequence

SEQ ID NO: 34014 - DNA, 174 bp, Unknown
  internal ribosome entry sequence
cccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtg

SEQ ID NO: 34015 - DNA, 174 bp, Unknown
  internal ribosome entry sequence
atacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagttt

SEQ ID NO: 34016 - DNA, 174 bp, Unknown
  internal ribosome entry sequence
tccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctc

SEQ ID NO: 34017 - DNA, 174 bp, Unknown
  internal ribosome entry sequence
gtttacttcccctgccagcattggggtgctctctaagcaacagtaggcggagagtggtctggcgtattaaaaacaaaggatcgtcaagtgggccttcccaggcattgctttgacttagtacatgtagaggatgtggcagttctctccgtccctgccactgctggtttctttgtt

SEQ ID NO: 34018 - DNA, 174 bp, Unknown
  internal ribosome entry sequence
tattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggacc

SEQ ID NO: 34019 - DNA, 174 bp, Unknown
  internal ribosome entry sequence
ccagcggaagtaattctttcgactgccccggaacccaccggagcaggcagctgggggtgggggggcggccctgggataggggctgtggcagtacgcggggacccggctgcggtggctgcgggactgacgaatggagaggagaaaacctatggtggctgtgaaggacctgatgcc

SEQ ID NO: 34020 - DNA, 174 bp, Unknown
  internal ribosome entry sequence
atggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggc

SEQ ID NO: 34021 - DNA, 174 bp, Unknown; identical to SEQ ID NO: 33967
  internal ribosome entry sequence

SEQ ID NO: 34022 - DNA, 174 bp, Unknown
  internal ribosome entry sequence
atttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgcca

SEQ ID NO: 34023 - DNA, 174 bp, Unknown
  internal ribosome entry sequence
ctctggtgatacagaagaaaagacagtctccattttcaaacagtccctcctgggagaacacagacaggcagaggattacaacacaaggcagcaagcactgggagacgaaagttttggcatctgttccctggctgtgccaagatgggcgattggagcttcctgggaaatttcctg

SEQ ID NO: 34024 - DNA, 174 bp, Unknown
  internal ribosome entry sequence
gtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccgg

SEQ ID NO: 34025 - DNA, 174 bp, Unknown
  internal ribosome entry sequence
tttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattg

SEQ ID NO: 34026 - DNA, 174 bp, Unknown
  internal ribosome entry sequence
tgtctgcaccagccggcctccagcctggctggaccctgctgcctgtgtggcccggagccagaggcccccacactcccagctgctcttctacagatgccatcaacgagcaggactctgggtggctccactgtctaagggctctgcgagtgacccggcgggcgagctccgtgctgc

SEQ ID NO: 34027 - DNA, 174 bp, Unknown
  internal ribosome entry sequence
cttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccatta

SEQ ID NO: 34028 - DNA, 174 bp, Unknown
  internal ribosome entry sequence
attcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgagga

SEQ ID NO: 34029 - DNA, 174 bp, Unknown
  internal ribosome entry sequence
gagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggagga

SEQ ID NO: 34030 - DNA, 174 bp, Unknown
  internal ribosome entry sequence
gccccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgca

SEQ ID NO: 34031 - DNA, 174 bp, Unknown
  internal ribosome entry sequence
agtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaat

SEQ ID NO: 34032 - DNA, 174 bp, Unknown
  internal ribosome entry sequence
ggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaat

SEQ ID NO: 34033 - DNA, 174 bp, Unknown
  internal ribosome entry sequence
tatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagagg

SEQ ID NO: 34034 - DNA, 174 bp, Unknown
  internal ribosome entry sequence
tgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaacta

SEQ ID NO: 34035 - DNA, 174 bp, Unknown
  internal ribosome entry sequence
acgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaa

SEQ ID NO: 34036 - protein, 4 aa, Unknown
  DEAD box motif
DEAD

SEQ ID NO: 34037 - protein, 4 aa, Unknown
  DEAH box motif
DEAH

SEQ ID NO: 34038 - protein, 20 aa, Unknown
  Zinc finger motif
  SITE (2)..(19): Xaa is any amino acid
CXXXXXXXXXXXXXXXXXXH

SEQ ID NO: 34039 - RNA, 7 nt, Unknown
  Kozak consensus sequence
accaugg
